US 6,720,139 B1

(12) United States Patent
Zyskind et al.

(10) Patent No.: US 6,720,139 B1
(45) Date of Patent: Apr. 13, 2004

(54) **GENES IDENTIFIED AS REQUIRED FOR PROLIFERATION IN *ESCHERICHIA COLI***

(75) Inventors: Judith Zyskind, La Jolla, CA (US); Kari L. Ohlsen, San Diego, CA (US); John Trawick, La Mesa, CA (US); R. Allyn Forsyth, San Diego, CA (US); Jamie M. Froelich, San Diego, CA (US); Grant J. Carr, Escondido, CA (US); Robert T. Yamamoto, San Diego, CA (US); H. Howard Xu, San Diego, CA (US)

(73) Assignee: Elitra Pharmaceuticals, Inc., San Diego, CA (US)

( * ) Notice: Subject to any disclaimer, the term of this patent is extended or adjusted under 35 U.S.C. 154(b) by 0 days.

(21) Appl. No.: 09/492,709

(22) Filed: Jan. 27, 2000

Related U.S. Application Data

(60) Provisional application No. 60/117,405, filed on Jan. 27, 1999.

(51) Int. Cl.[7] .............. C12Q 1/68; C12Q 1/00; A01N 37/18; A01N 43/04
(52) U.S. Cl. ............... 435/6; 514/2; 514/44; 435/4
(58) Field of Search ............. 435/4, 6, 69.1; 514/2, 44; 436/501

(56) References Cited

U.S. PATENT DOCUMENTS

| | | | |
|---|---|---|---|
| 4,622,297 A | 11/1986 | Kappner et al. | 435/32 |
| 4,906,742 A | 3/1990 | Young et al. | |
| 4,980,281 A | 12/1990 | Housey | 435/29 |
| 5,082,767 A | 1/1992 | Hatfield et al. | 435/6 |
| 5,142,047 A | 8/1992 | Summerton et al. | 544/118 |
| 5,190,931 A | 3/1993 | Inouye | 435/91 |
| 5,208,149 A | 5/1993 | Inouye | 435/91 |
| 5,266,464 A | 11/1993 | Housey | 435/29 |
| 5,272,065 A | 12/1993 | Inouye et al. | 435/91.1 |
| 5,353,236 A | 10/1994 | Subbiah | 364/499 |
| 5,405,775 A | 4/1995 | Inouye et al. | 435/252.33 |
| 5,463,564 A | 10/1995 | Agrafiotis et al. | 364/496 |
| 5,569,588 A | 10/1996 | Ashby et al. | 435/6 |

(List continued on next page.)

FOREIGN PATENT DOCUMENTS

| | | |
|---|---|---|
| EP | 0 786 519 A2 | 7/1997 |
| EP | 0 786 519 A3 | 7/1997 |

(List continued on next page.)

OTHER PUBLICATIONS

Gucev et al., Cancer Research, vol. 56, No. 7, pp. 1545–1550, 1996.*

Armstrong, K.A. and Fan, D.P., "Essential Genes in the metB–malB Region of *Escherichia coli* K12," J. Bacteriol. 126: 48–55 (1975).

(List continued on next page.)

*Primary Examiner*—Ardin H. Marschel
(74) *Attorney, Agent, or Firm*—Knobbe Martens Olson & Bear LLP

(57) ABSTRACT

The sequences of nucleic acids encoding proteins required for *E. coli* proliferation are disclosed. The nucleic acids can be used to express proteins or portions thereof, to obtain antibodies capable of specifically binding to the expressed proteins, and to use those expressed proteins as a screen to isolate candidate molecules for rational drug discovery programs. The nucleic acids can also be used to screen for homologous genes that are required for proliferation in microorganisms other than *E. coli*. The nucleic acids can also be used to design expression vectors and secretion vectors. The nucleic acids of the present invention can also be used in various assay systems to screen for proliferation required genes in other organisms as well as to screen for antimicrobial agents.

49 Claims, 3 Drawing Sheets

U.S. PATENT DOCUMENTS

| | | | |
|---|---|---|---|
| 5,574,656 A | 11/1996 | Agrafiotis et al. | 364/500 |
| 5,585,277 A | 12/1996 | Bowie et al. | 436/518 |
| 5,612,180 A | 3/1997 | Brown et al. | 435/6 |
| 5,639,603 A | 6/1997 | Dower et al. | 435/6 |
| 5,679,523 A | 10/1997 | Li et al. | |
| 5,684,711 A | 11/1997 | Agrafiotis et al. | 364/500 |
| 5,688,655 A | 11/1997 | Housey | 435/7.21 |
| 5,744,460 A * | 4/1998 | Muller et al. | 514/44 |
| 5,756,305 A | 5/1998 | Timberlake et al. | 435/34 |
| 5,807,522 A | 9/1998 | Brown et al. | 422/50 |
| 5,821,076 A | 10/1998 | Timberlake et al. | 435/34 |
| 5,846,772 A | 12/1998 | Hodgson et al. | |
| 5,854,020 A | 12/1998 | Hodgson et al. | |
| 5,858,709 A | 1/1999 | Hodgson et al. | |
| 5,869,290 A | 2/1999 | Freeman et al. | |
| 5,869,604 A | 2/1999 | Rousseau et al. | 530/344 |
| 5,874,281 A | 2/1999 | Dattagupta et al. | 435/238 |
| 5,874,567 A | 2/1999 | Smith | 536/24.5 |
| 5,877,007 A | 3/1999 | Housey | 435/252.3 |
| 5,882,643 A | 3/1999 | Lonetto | |
| 5,885,572 A | 3/1999 | Gentry et al. | |
| 5,891,667 A | 4/1999 | Hodgson et al. | |
| 5,910,414 A | 6/1999 | Gwynn et al. | |
| 5,955,275 A | 9/1999 | Kamb | |
| 5,965,352 A | 10/1999 | Stoughton et al. | 435/4 |
| 5,972,708 A | 10/1999 | Sherratt et al. | 435/479 |
| 6,015,669 A | 1/2000 | Holden | 435/6 |
| 6,020,121 A | 2/2000 | Bao et al. | |
| 6,037,123 A | 3/2000 | Benton et al. | |
| 6,077,682 A | 6/2000 | Inouye et al. | 435/15 |
| 6,139,817 A | 10/2000 | Palmer et al. | 424/9.1 |
| 6,156,526 A | 12/2000 | Boriack-Sjodin et al. | 435/18 |
| 6,171,838 B1 | 1/2001 | Black | 435/193 |
| 6,174,678 B1 | 1/2001 | Menzel et al. | 435/6 |
| 6,228,579 B1 | 5/2001 | Zyskind et al. | 435/6 |
| 6,228,588 B1 | 5/2001 | Benton et al. | 435/6 |
| 6,248,525 B1 | 6/2001 | Nilsen | 435/6 |
| 6,277,564 B1 * | 8/2001 | Berlin et al. | 435/6 |
| 6,303,115 B1 | 10/2001 | Natsoulis | 424/93.2 |
| 6,348,582 B1 | 2/2002 | Black et al. | 536/23.1 |
| 2002/0058260 A1 | 5/2002 | Zyskind et al. | 435/6 |
| 2002/0115217 A1 | 8/2002 | Fan et al. | 435/455 |

FOREIGN PATENT DOCUMENTS

| | | |
|---|---|---|
| EP | 0816511 A1 | 1/1998 |
| EP | 0837142 A1 | 4/1998 |
| EP | 0889123 A2 | 1/1999 |
| EP | 0889129 A2 | 1/1999 |
| EP | 0891984 A2 | 1/1999 |
| EP | 0892056 A2 | 1/1999 |
| EP | 0892064 A2 | 1/1999 |
| EP | 0894806 A1 | 2/1999 |
| EP | 0897008 A2 | 2/1999 |
| EP | 0900845 A2 | 3/1999 |
| EP | 0905247 A2 | 3/1999 |
| EP | 0906959 A2 | 4/1999 |
| WO | WO 95/02823 | 1/1995 |
| WO | WO 95/06132 | 3/1995 |
| WO | WO 95/29254 | 11/1995 |
| WO | WO 96/17951 | 6/1996 |
| WO | WO 96/23075 | 8/1996 |
| WO | WO 96/40979 | 12/1996 |
| WO | WO 97/11690 | 4/1997 |
| WO | WO 97/16177 | 5/1997 |
| WO | WO 97/23642 | 7/1997 |
| WO | WO 97/27212 | 7/1997 |
| WO | WO 97/272213 | 7/1997 |
| WO | WO 97/37026 | 10/1997 |
| WO | WO 97/40851 | 11/1997 |
| WO | WO 97/42210 | 11/1997 |
| WO | WO 97/48822 | 12/1997 |
| WO | WO 98/03533 | 1/1998 |
| WO | WO 98/19162 | 5/1998 |
| WO | WO 98/20161 | 5/1998 |
| WO | WO 98/21366 | 5/1998 |
| WO | WO 98/42854 | 10/1998 |
| WO | WO 98/44135 | 10/1998 |
| WO | WO 99/02673 | 1/1999 |
| WO | WO 99/06839 | 2/1999 |
| WO | WO 99/13893 | 3/1999 |
| WO | WO 99/18238 | 4/1999 |
| WO | WO 99/23244 | 5/1999 |
| WO | WO 99/26651 | 6/1999 |
| WO | WO 99/27074 | 6/1999 |
| WO | WO 99/27128 | 6/1999 |
| WO | WO 99/28508 | 6/1999 |
| WO | WO 9929837 | 6/1999 |
| WO | WO 99/33871 | 7/1999 |
| WO | WO 99/35494 | 7/1999 |
| WO | WO 99/36554 | 7/1999 |
| WO | WO 99/43338 | 9/1999 |
| WO | WO 99/49888 | 10/1999 |
| WO | WO 99/50462 | 10/1999 |
| WO | WO 99/52926 | 10/1999 |
| WO | WO 99/53079 | 10/1999 |
| WO | WO 99/54728 | 10/1999 |
| WO | WO 99/55729 | 11/1999 |
| WO | WO 99/61452 | 12/1999 |
| WO | WO 00/34481 | 6/2000 |
| WO | WO 00/61793 | 10/2000 |
| WO | WO 01/07061 A1 | 2/2001 |
| WO | WO 01/09164 A2 | 2/2001 |
| WO | WO 01/11081 A2 | 2/2001 |
| WO | WO 01/34809 A2 | 5/2001 |
| WO | WO 01/49721 A2 | 7/2001 |
| WO | WO 01/49775 A2 | 7/2001 |
| WO | WO 03/034027 A2 | 4/2003 |

OTHER PUBLICATIONS

Biswas, E.E. and Biswas, S.B., "Mechanism and DnaB Helicase of *Escherichia coli*: Structural Domains Involved in ATP Hydrolysis, DNA Binding, and Oligomerization," Biochem. 38:10919–10928 (1999).

Blattner, et al., "The Complete Genome Sequence of *Escherichia coli* K–12," Science 277:1453–1474 (1997).

den Hollander, J.G., et al., "Synergism Between Tobramycin and Ceftazidime Against a Resistant *Pseudomonas aeruginosa* Strain, Tested in an In Vitro Pharmacokinetic Model," Antimicrobia Agents & Chemotherapy 41:95–110 (1997).

Fukuoka, T., et al., "Combination Effect Between Panipenem and Vancomycin on Highly Methicillin–Resistant *Staphylococcus aureus*," Japan. J. Antibio. 50:411–419 (1997).

Gabryelewicz, A., et al., "Multicenter Evaluation of Dual-–Therapy (Omeprazol and Amoxycillin) for *Helicobacter pylori*–Associated Duodenal and Gastric Ulcer (Two Years of the Observation)," J. Physiol. Pharmacol. 48 Suppl. 4:93–105 (1997).

Gutmann, L., et al., "Involvement of Pencillin–Binding Protein 2 with other Pencillin–Binding Proteins in Lysis of *Escherichia coli* by some Beta–Lactam Antibiotics Alone and in Synergistic Lytic Effect of Amdinocillin (Mecillinam)," Antimicrobial Agents & Chemotherapy 30:906–912 (1986).

Hiasa, H. and Marians, K.J., "Initiation of Bidirectional Replication at the Chromosomal Origin is Directed by the Interaction Between Helicase and primase," J. Biol. Chem. 274:27244–27248 (1999).

Holzmayer, T.A., et al., "Isolation of Dominant Negative Mutants and Inhibitory Antisense RNA Sequences by Expression Selection of Random DNA Fragments," Nucleic Acids Res. 20(4): 711–717 (Feb. 25, 1992).

San Martin, C., et al., "Three–Dimensional Reconstructions from Cryoelectron Microscopy Images Reveal an Initimate Complex Between Helicase DnaB and its Loading Partner DnaC," Structure 6:501–9 (1998).

Smith, C. E., et al., "Assessment of the Synergistic Interactions of Levofloxacin and Ampicillin Against Enterococcus Faecium by the Checkerboard Agar Dilution and Time–Kill Methods," Diagnos. Microbiol. Infect. Disease 27:85–92 (1997).

Sutton, M.D., et al, "*Escherichia coli* DnaA Protein. The N–Terminal Domain and Loading of DnaB Helicase at the *E. coli* Chromosomal," J. Biol. Chem. 273:34255–62 (1998).

Wechsler, J.A. and Gross, J.D., "*Escherichia coli* Mutants Temperature–Sensitive for DNA Synthesis," Mol. Gen. Genetics 113:273–284 (1971).

Yinduo Ji, et al., "Regulated Antisense RNA Eliminates Alpha–Toxin Virulence in *Staphylococcus aureus* Infection," J. Bacteriology 181(21): 6585–6590 (Nov. 1999).

Post et al., Nucleotide Sequence of the Ribosomal Protein Gene Cluster Adjacent to the Gene for RNA Polymerase Subunit Beta in *Escherichia coli*, Proceedings of the National Academy of Sciences of the USA, NY, NY vol. 76, No. 4, (1979) pp. 1697–1701.

Austin, A. E., et al., *Journal of Bacteriology*, 172:5312–5325, 1990, "Genetic Analysis of Lipopolysaccharide Core Biosynthesis by *Escherichia coli* k12 Insertion Mutagenesis of the RFA Locus."

Lee, N. G., et al., *Infection and Immunity*., 63(3):818–824, 1995, "Molecular Cloning and Characterization of the Nontypable Haemophilus Influenza–2019 rfaE Gene Required for Lipopolysaccharide Biosynthesis."

Valvano, M. A., et al., *Journal of Bacteriology*, 182:488–497, 2000, "The rfaE Gene from *Escherichia coli* Encodes a Bifunctional Protein Involved in Biosynthesis of the Lipopolysaccharide Core Precursor ADP–L–glycero–D––manno–heptose."

Van Heeswijk, W. C., et al., *Molecular Microbiology*, 9:443–457, 1993, "The Genes of the Glutamine Synthetase Adenylylation Cascade are not Regulated by Nitrogen in *Escherichia coli*."

U.S. patent application No. 08/896,342, filed Jul. 18, 1997.
U.S. Provisional patent application No. 60/060,767, filed Oct. 2, 1997.
U.S. patent application No. 09/361,318, filed Jul. 27, 1999.
U.S. patent application No. 09/697,258.

Gudkov, et al. 1997. "Isolation of Genetic Suppressor Elements (GSEs) from Random Fragment cDNA Libraries in Retroviral Vectors." In Cowell, et al. (Eds.). Methods in Molecular Biology, vol. 69 cDNA Library Protocols, Totowa, NY: Humana Press, Inc.

Sofia, et al. 1994. Analysis of the *Escherichia coli* genome. V. DNA sequence of the region from 76.0 to 81.5 minutes. Database accession No. P37619 (XP–002228916).

Almarsson, et al. 1993. Peptide nucleic acid (PNA) conformation and polymorphism in PNA–DNA and PNA–RNA hybrids. *Proc. Natl. Acad. Sci. U.S.A.*, 90:9542–9546.

Altschul, et al. 1990. Basic local alignment search tool. *J. Mol. Biol.*, 215:403–10.

Altschul, et al. 1997. Gapped BLAST and PSI–BLAST: A new generation of protein database search programs. *Nucleic Acid Res.*, 25(17): 3389–3402.

Arigoni, et al. 1998. A genome–based approach for the identification of essential bacterial genes. *Nature Biotechnology*, 16: 851–856.

Ausubel, et al. (Eds.). 1997. Current Protocols in Molecular Biology, vol. 1, Unit 1.8.1–1.8.10. John Wiley & Sons, Inc.

Basu, et al. 1997. Synthesis and characterization of a peptide nucleic acid conjugated to a D–peptide analog of insulin––like growth factor 1 for increased cellular uptake. *Bioconjugate Chem.*, 8:481–488.

Bentin, et al. 1996. Enhanced peptide nucleic acid binding to supercoiled DNA: Possible implications for DNA "breathing" dynamics. *Biochemistry*, 35:8863–8869.

Cao, et al. 1993. Expression and functional analysis of steroid receptor fragments secreted from *Staphylococcus aureus*. *J. Steroid Biochem Molec. Biol.*, 44(1):1–11.

Cotrim, et al. 1999. Isolation of genes mediating resistance to inhibitors of nucleoside and ergosterol metabolism in Leishmania by overexpression/selection. *Journal of Biological Chemistry*, 274(53):37723–37730.

Demidov, et al. 1995. Kinetics and mechanism of polyamide ("peptide") nucleic acid binding to duplex DNA. *Proc. Natl. Acad. Sci. U.S.A.*, 92:2637–2641.

Demdov, et al. 1993. Sequence selective double strand DNA cleavage by Peptide Nucleic Acid (PNA) targeting using nuclease S1. *Nucl. Acids. Res.*, 21(9):2103–2107.

Demidov, et al. 1994. Stability of peptide nucleic acids in human serum and cellular extracts. *Biochem. Pharm.*, 48(6):1010–1313.

Egholm et al. 1995. Efficient pH–independent sequence–specific DNA binding by pseudoisocytosine–containing bis–PNA. *Nucleic Acids Res.*, 23(2):217–222.

Egholm, et al. 1993. PNA hybridizes to complementary oligonucleotides obeying the Watson–Crick hydrogen––bonding rules. *Nature*, 365:566–568.

Egholm, et al. 1992. Recognition of Guanine and Adenine in DNA by Cytosine and Thymine Containing Peptide Nucleic Acids (PNA) *J. Am. Chem. Soc.*, 114(24)9677–9678.

Engvall, E. 1980. Enzyme Immunoassay ELISA and EMIT. *Meth. Enzymol.* 70:419–439.

Etzold, et al. 1993 Sequence Retrieval System (SRS) SRS–An indexing and retrieval tool for flat file data libraries. *Comput. Appl. Biosci.* 9(1):49–57.

Gallop, et al. 1994 Applications of Combinatorial Technologies to Drug Discovery. 1. Background and Peptide Combinatorial Libraries. *Journal of Medicinal Chemistry*, 37(9):1233–1251.

Griffin, et al. 1989. Recognition of Thymine Adenine Base Pairs by Guanine in a Pyrimidine Triple Helix Motif. *Science*, 245:967–971.

Griffith. et al. Single and bis peptide nucleic acids as triplexing agents Binding and Stoichiometry. 1995. *J. Am. Chem. Soc.*, 117:831–832.

Hamilton, et al. 1989. New method for generating deletions and gene replacements in *Escherichia coli*. *J. Bacteriol.*, 171(9):4617–4622.

Hanvey, et al. 1992. Antisense and antigene properties of peptide nucleic acids. *Science*, 258:1481–1484.

Hensel, et al. 1995. Simultaneous identification of bacterial virulence genes by negative selection. *Science*, 269:400–403.

Hirschman, et al. 1996 Peptide nucleic acids stimulate gamma interferon and inhibit the replication of the human immunodeficiency virus. *J. Investig. Med.*, 44(6):347–351.

Ho, et al. 1989. Site–directed mutagenesis by overlap extension using the polymerase chain reaction. *Gene*, 77:51–59.

Horton, et al. 1989. Engineering hybrid genes without the use of restriction enzymes: Gene splicing by overlap extension. *Gene*, 77:61–68.

Huerta, et al. 1998. RegulonDB: A database on transcriptional regulation in *Escherichia coli*. *Nucl. Acids Res.*, 26(1):55–59.

Kohler, et al. 1975. Continuous cultures of fused cells secreting antibody of predefined specificity. *Nature*, 256:495–497.

Krause, et al. 1997. Complexes at the replication origin of *Bacillus subtilis* with homologous and heterologous dnaA protein. *J. Mol. Biol.*, 274:365–380.

Le Good, et al. 1996, Protein kinase C isotypes controlled by phospho.nositide 3–kinase through the protein kinase PDK1. *Science*, 281:2042–2045.

Link, et al. 1997. Methods for Generating Precise Deletions and Insertions in the Genome of Wild–Type *Escherichia coli*: Application to Open Reading Frame Characterization. *J. Bacteriol.*, 179(20):6228–6237.

Margolis, et al. 2000. Peptide Deformylase in *Staphylococcus aureus*: Resistance to Inhibition is Mediated by Mutations in the Formyltransferase Gene. *Antimicrobial Agents and Chemotherapy*, 44(7):1825–1831.

Matsukura, et al 1988. Synthesis of phosphorothioate analogues of oligodeoxyribonucleotides and their activity against human immunodeficiency virus (HIV). *Gene*, 72:343.

Mollegaard, et al. 1994. Peptide nucleic acid DNA strand displacement loops as artificial transcription promoters. *Proc. Natl. Acad. Sci. U.S.A.*, 91:3892–3895.

Nielsen, et al. 1991. Sequence–selective recognition of DNA by strand displacement with a thymine–substituted polyamide. *Science*, 254:1497–1500.

Nielsen, et al. 1993. Sequence specific inhibition of DNA restriction enzyme cleavage by PNA. *Nucl. Acids. Res.*, 21(2):197–200.

Nielsen, et al. 1994. Sequence–specific transcription arrest by peptide nucleic acid bound to the DNA template strand. *Gene*, 149:139–145.

Norton, et al. 1996. Inhibition of human telomerase activity by peptide nucleic acids. *Nature Biotechnol.*, 14:615–619.

Pardridge, et al. 1995. Vector–mediated delivery of a polyamide ("peptide") nucleic acid analogue through the blood–brain barrier in vivo. *Proc. Natl. Acad. Sci. U.S.A.*, 92:5592–5596.

Pearson, W. R. 1990. Rapid and sensitive sequence comparison with FASTP and FASTA. *Methods in Enzymology*, 183:63–98.

Plá, et al. 1990. Cloning and expression of the ponB gene, encoding penicillin–binding protein 1B of *Escherichia coli*, in heterologous systems. *J. Bacteriol.*, 172(8):4448–4455.

Rossi, et al. 1991. The potential use of catalytic RNAs in therapy of HIV infection and other diseases. *Pharmac. Ther.*, 50:245–254.

Rudd, K. E. 1998. Linkage map of *Escherichia coli* K–12, edition 10: The physical map. *Micro. & Mol. Biol. Rev.*, 62(3):985–1019.

Schena, et al. 1995. Quantitative monitoring of gene expression patterns with a complementary DNA microarray. *Science*, 270:467–470.

Shalon, et al. 1996. A DNA microarray system for analyzing complex DNA samples using two–color fluorescent probe hybridization. *Genome Research*, 6:639–645.

Tao, et al. 2000. Drug target validation: Lethal infection blocked by inducible peptide. *PNAS*, 97(2):783–786.

Uhlmann, et al. 1990. Antisense Oligonucleotides: A New Therapeutic Principle. *Chemical Reviews*, 90(4):543–584.

Vaitukaitis, et al. 1971. A method for producing specific antisera with small doses of immunogen. *J. Clin. Endocr. Metab.*, 33:988–991.

Zhang, et al. 1996. Polar Allele Duplication for Transcriptional analysis of consecutive essential genes: Application to a cluster of *Escherichia coli* fatty acid biosynthetic genes. *J. Bacteriol.*, 178(12):3614–3620.

Zhang, et al. 2000. Regulated Gene Expression in *Staphylococcus aureus* for Identifying Conditional Lethal Phenotypes and Antibiotic Mode of Action *Gene*. 255:297–305.

Akerley, et al., "A genome–scale analysis for identification of genes required for growth or survival of *Haemophilus influenzae*." *PNAS*, 99(2):966–971 (2002).

Blattner, et al., "*Escherichia coli* K12 MG 1655 section 101 of 400 fof the complete genome," Database accession No. AE000211, XP002181472, (1997).

Blattner, et al., "*Escherichia coli* K12 MG1655 section 298 of 400 of the complete genome," Database accession No. AE000408, XP002181129, (1997).

Blattner, et al., "*Escherichia coli* K12 MG1655 section 305 of 400 of the complete genome," Database accession No. AE000415, XP002181474, (1997).

Blattner, et al., "*Escherichia coli* K12 MG1655 section 337 of 400 of the complete genome," Database accession No. AE000447, XP002181127, (1997).

Blattner, et al., "Hypothetical 79.5 kDA protein in MRCA–PCKA intergenic region (0711)." Database accession No. P45800. XP002181475, (1995).

Blattner, et al., "Hypothetical protein YCFS precursor," Database accession No. P75954, XP002181473, (2000).

Burland, et al., "60 kDa inner–membrane protein," Database accession No. P25714, XP002181128, (1992).

Burland, et al., "*E. coli*; the region from 81.5 to 84.5 minutes," Database accession No. L10328, XP002181130, (1993).

Burland, et al., "DNA sequence and analysis of 136 kilobases of the *Escherichia coli* genome: Organizational symmetry around the origin of replication," *Genomics*, 16:551–561 (1993).

Ceretti, et al., "*Escherichia coli* spc ribosomal protein operon," Database accession No. X01563, XP002181131, (1985).

De Backer, et al., "An antisense–based functional genomics approach for identification of genes critical for growth of *Candida albicans*." *Nature Biotechnology*, 19:235–241 (2001).

Lancy, et al., "Nucleotide Sequences of dnaE, the Gene for the Polymerase Subunit of DNA Polymerase III in *Salmonella typhimurium*, and a Variant That Facilitates Growth in the Absence of Another Polymerase Subunit," *Journal of Bacteriology*, 171(10):5581–5586 (1989).

Oshima, et al., "A 718–kb DNA Sequence of the *Escherichia coli* K–12 Genome Corresponding to the 12.7–28.0 min Region on the Linkage Map," *DNA Research*, 3:137–155 (1996).

Oshima, et al., "*Escherichia coli* genomic DNA (25.2–25.6 min)," Database accession No. D90747, XP002181476 (1996).

Plunkett, et al., "*Escherichia coli* K–12 chromosomal region from 67.4 to 76.0 minutes," Database accession No. U18997, XP002181132, (1994).

Plunkett, et al., "*Escherichia coli* K–12 chromosomal region from 67.4 to 76.0 minutes," Database accession No. U18997, XP002181477, (1994).

Appelt, K. 1993. Crystal structures of HIV–1 protease–inhibitor complexes. *Perspectives in Drug Discovery and Design*, 1:23–48.

Bagby, et al. 1994 Unusual helix–containing Greek keys in development–specific $Ca^{2+}$–binding protein S $^1$H. $^{15}$N. and $^{13}$C assignments and secondary structure determined with the use of multidimensional double and triple resonance heteronuclear NMR spectroscopy *Biochemistry*, 33:2409–2421.

Bagby, et al 1995 Solution structure of the C–terminal core domain of human TFIIB: Similarity to Cyclin A and interaction with TATA–binding protein *Cell* 82:857–867.

Balbes, et al. 1994. "A perspective of modern methods in computer–aided drug design," In Lipkowitz, et al., Eds. Reviews in Computational Chemistry V. Chap. 7, pp. 337–379, New York: VCH Publishers.

Brunschwig, et al. 1992 A two–component T7 system for the overexpression of genes in *Pseudomonas aeruginosa Gene*, 111:35–41.

Bugg, et al. 1993. Drugs by design: Structure–based design, an innovative approach to developing drugs, has recently spawned many promising therapeutic agents, including several now inhuman trials for treating AIDS, cancer and other diseases. *Scientific American*, Dec.:92–98.

Clore, et al 1987. Three–dimensional structure of potato carboxypeptidase inhibitor in solution: A study using nuclear magnetic resonance, distance geometry, and restrained molecular dynamics. *Biochemistry*, 26:8012–8023.

Crosa, et al. 1973. Molecular relationships among the Salmonelleae. *J. Bacteriol*, 115(1):307–315.

Cwirla, et al 1990 Peptides on phage: A vast library of peptides for identifying ligands *Proc. Acad. Natl. Sci. USA*, 87: 6378–6382.

Devlin, et al 1990 Random peptide libraries: A source of specific protein binding molecules. *Science*, 249:404–406.

Edwards, B. H. 1999 Salmonella and Shigella species *Clinics Lab Mea.*, 19(3):469–487.

Erickson, J W 1993 Design and structure of symmetry––based inhibitors of HIV–1 protease *Perspectives in Drug Discovery and Design*, 1:109–128.

Good, et al 1998 Antisense inhibition of gene expression in bacteria by PNA targeted to mRNA. *Nature Biotechnology*, 16:355–358.

Huycke, et al 1998 Multiple–drug resistant enterococci The nature of the problem and an agenda for the future *Emerging Infectious Diseases*. 4(2):239–249.

Israelser, et al 1995 Cloning and partial characterization of regulated promoters from *Lactococcus lactis* Tn917–lacZ integrants with the new promoter probe vector, pAK80, *Applied and Environmental Microbiology*, 61(7):2540–2547.

Kreiswirth, et al 1983 The toxic shock syndrome exotoxin structural gene is not detectably transmitted by a prophage *Nature*, 305:709–712.

Lam, et al 1994 Rational design of potent, bioavailable, nonpeptide cyclic areas as HIV protease inhibitors *Science* 263:380–384.

Marrone, et al. 2000 Discovering high–affinity ligands from the computationally predicted structures and affinities of small molecules bound to a target. A virtual screening approach. *Perspectives in Drug Discovery and Design*, 20:209–230.

Mestres, et al. 2000. Similanty versus docking in 3D virtual screening. *Perspectives in Drug Discovery and Design*, 20:191–207.

Mojumdar, et al. 1988. Characterization of the tetracycline resistance gene of plasmid pT181 of *Staphylococcus aureus J. Bacteriology*, 170(12):5522–5528.

Moszer, et al 1995. SubtiList A relational database for the *Bacillus subtilis* genome *Microbiology*, 141:261–268.

Moszer, I 1998 The complete genome of *Bacillus subtilis*. From sequence annotation to data management and analysis *FEBS Letters*, 430:28–36.

Neidhardt, F C (Ed) 1996 *Escherichia coli* and Salmonella Cellular and molecular biology, 2nd Ed. vol. 2, pp 2269–2271 Washington D C ASM Press.

Schnappinger, et al 1995 Extracellular expression of native human anti–lysozyme fragments in *Staphylococcus camosus FEMS Microbiol Let* 129:121–127.

Scott, et al 1990, Searching for peptide ligands with an epitope library *Science*, 249:386–390.

Shuker, et al 1996. Discovering high–affinity ligands for proteins: SAR by NMR. *Science*, 274:1531–1534.

Suh, et al. 1995. Genetic and transcriptional organization of the *Bacillus subtilis* spc–alpha region. Database accession No. L47971 (ID BSRPLP). XP002190118.

Suh, et al. 1996. Genetic and transcriptional organization of the *Bacillus subtilis* spc–alpha region. *Gene*, 169:17–23.

Tatusov, et al. 2000. The COG database: A tool for genome–scale analysis of protein functions and evolution. *Nucleic Acids Research*, 28(1):33–36.

Van Delden, et al. 1998. Cell–to–cell signaling and *Pseudomonas aeruginosa* infections. *Emerging Infectious Diseases*, 4(4):551–560.

Wagner, et al. 1987 Protein structures in solution by nuclear magnetic resonance and distance geometry: The polypeptide fold of the basic pancreatic trypsin inhibitor determined using two different algorithms, DISGEO and DISMAN, *J. Mol. Biol.*, 196:611–639.

Wlodawer, et al 1993 Structure–based inhibitors of HIV–1 protease *Annu. Rev Biochem.*, 62:543–585.

Wüthrich, et al. 1983 Pseudo–structures for the 20 common amino acids for use in studies of protein conformations by measurements of intramolecular proton–proton distance constraints with nuclear magnetic resonance *J. Mol. Biol.*, 169:949–961.

Xia, et al 1999 Rapid method for the identification of essential genes in *Staphylococcus aureus Plasmid*. 42:144–149.

Good, et al. 1998 Inhibition of translation and bacterial growth by peptide nucleic acid targeted to ribosomal RNA. *Proc. Natl. Acad. Sci. USA*, 95:2073–2076.

Branch, A. D. 1998. A good antisense molecule is hard to find. *TIBS*, 23:45–50.

Dove, A. 2002. Antisense and sensibility *Nature Biotechnology*, 20:121–124.

Lebedeva, et al. 2001. Antisense oligonucleotides: Promise and reality. *Annu. Rev. Pharmacol. Toxicol.*, 41:403–419.

Bennett, F. C. 1998. Antisense oligonucleotides: Is the glass half full or half empty! *Biochemical Pharmacology*, 55:9–19.

Crooke, S. T. 1998. An overview of progress in antisense therapeutics. *Antisense & Nucleic Acid Drug Development*, 8:115–122.

Gura, T. 1995. Antisense has growing pains. *Science*, 270:575–577.

* cited by examiner

US 6,720,139 B1

GENES IDENTIFIED AS REQUIRED FOR PROLIFERATION IN *ESCHERICHIA COLI*

RELATED APPLICATIONS

This application claims priority from U.S. Provisional Patent Application Serial No. 60/117,405 filed Jan. 27, 1999, the disclosure of which is incorporated herein by reference in its entirety.

The present application includes a Sequence Listing containing nucleic acid and polypeptide sequences. The Sequence Listing is provided in electronic format on duplicate copies of a CD-ROM marked "Copy 1" and "Copy 2". The duplicate copies of the CD-ROM each contain a file entitled 001asubst.txt created on Jul. 20, 2001 which is 702,473 bytes in size. The information on these duplicate CD-ROMs is incorporated herein by reference in its entirety.

BACKGROUND OF THE INVENTION

Since the discovered of penicillin, the use of antibiotics to treat the ravages of bacterial infections has saved millions of lives. With the advent of these "miracle drugs," for a time it was popularly believed that humanity might, once and for all, be saved from the scourge of bacterial infections. In fact, during the 1980s and early 1990s, many large pharmaceutical companies cut back or eliminated antibiotics research and development. They believed that infectious disease caused by bacteria finally had been conquered and that markets for new drugs were limited. Unfortunately, this belief was overly optimistic.

The tide is beginning to turn in favor of the bacteria as reports of drug resistant bacteria become more frequent. The United States Centers for Disease Control announced that one of the most powerful known antibiotics, vancomycin, was unable to treat an infection of the common *Staphylococcus aureus* (staph). This organism is commonly found in our environment and is responsible for many nosocomial infections. The import of this announcement becomes clear when one considers that vancomycin was used for years to treat infections caused by stubborn strains of bacteria, like staph. In short, the bacteria are becoming resistant to our most powerful antibiotics. If this trend continues, it is conceivable that we will return to a time when what are presently considered minor bacterial infections are fatal diseases.

There are a number of causes for the predicament in which practitioners of medical arts find themselves. Overprescription and improper prescription habits by some physicians have caused an indiscriminate increase in the availability of antibiotics to the public. The patient is also partly responsible, for even in instances where an antibiotic is the appropriate treatment, patients will often improperly use the drug, the result being yet another population of bacteria that is resistant, in whole or in part, to traditional antibiotics.

The bacterial scourges that have haunted humanity remain, in spite of the development of modern scientific practices to deal with the diseases that they cause. Drug resistant bacteria are now advancing on the health of humanity. A new generation of antibiotics to once again deal with the pending health threat that bacteria present is required.

DISCOVER OF NEW ANTIBIOTICS

As more and more bacterial strains become resistant to the panel of available antibiotics, new compounds are required. In the past, practitioners of pharmacology would have to rely upon traditional methods of drug discovery to generate novel, safe and efficacious compounds for the treatment of disease. Traditional drug discovery methods involve blindly testing potential drug candidate-molecules, often selected at random, in the hope that one might prove to be an effective treatment for some disease. The process is painstaking and laborious, with no guarantee of success. Today, the average cost to discover and develop a new drug is nearly US $500 million, and the average time is 15 years from laboratory to patient. Improving this process, even incrementally, would represent a huge advance in the generation of novel antimicrobial agents.

Newly emerging practices in drug discovery utilize a number of biochemical techniques to provide for directed approaches to creating new drugs, rather than discovering them at random. For example, gene sequences and proteins encoded thereby that are required for the proliferation of an organism make for excellent targets since exposure of bacteria to compounds active against these targets would result in the inactivation of the organism. Once a target is identified, biochemical analysis of that target can be used to discover or to design molecules that interact with and alter the functions of the target. Using physical and computational techniques, to analyze structural and biochemical targets in order to derive compounds that interact with a target is called rational drug design and offers great future potential. Thus, emerging drug discovery practices use molecular modeling techniques, combinatorial chemistry approaches, and other means to produce and screen and/or design large numbers of candidate compounds.

Nevertheless, while this approach to drug discovery is clearly the way of the future, problems remain. For example, the initial step of identifying, molecular targets for investigation can be an extremely time consuming task. It may also be difficult to design molecules that interact with the target by using computer modeling techniques. Furthermore, in cases where the function of the target is not known or is poorly understood, it may be difficult to design assays to detect molecules that interact with and alter the functions of the target. To improve the rate of novel drug discovery and development, methods of identifying important molecular targets in pathogenic microorganisms and methods for identifying molecules that interact with and alter the functions of such molecular targets are urgently required.

*Escherichia coil* represents an excellent model system to understand bacterial biochemistry and physiology. The estimated 4288 genes scattered along the $4.6 \times 10^6$ base pairs of the *Escherichia coli* (*E. coli*) chromosome offer tremendous promise for the understanding of bacterial biochemical processes. In turn, this knowledge will assist in the development of new tools for the diagnosis and treatment of bacteria-caused human disease. The entire *E. coli* genome has been sequenced, and this body of information holds a tremendous potential for application to the discovery and development of new antibiotic compounds. Yet, in spite of this accomplishment, the general functions or roles of many of these genes are still unknown. For example, the total number of proliferation-required genes contained within the *E. coli* genome is unknown, but has been variously estimated at around 200 to 700 (Armstrong, K. A. and Fan, D. P. Essential Genes in the metB-malB Region of *Escherichia coli* K12, 1975, J. Bacteriol. 126: 48–55).

Novel, safe and effective antimicrobial compounds are needed in view of the rapid rise of antibiotic resistant microorganisms. However, prior to this invention, the characterization of even a single bacterial gene was a painstaking process, requiring years of effort. Accordingly, there is an urgent need for more novel methods to identify and char-

SUMMARY OF THE INVENTION

One embodiment of the present invention is a purified or isolated nucleic acid sequence consisting essentially of one of SEQ ID NOs: 1–81, 405–485, wherein said nucleic acid inhibits microorganism proliferation. The nucleic acid sequence may be complementary to at least a portion of a coding sequence of a gene whose expression is required for microorganism proliferation. The nucleic acid sequence may comprise a fragment of one of SEQ ID NOs. 1–81, 405–485, said fragment selected from the group consisting of fragments comprising at least 10, at least 20, at least 25, at least 30, at least 50 or more than 50 consecutive-bases of one of SEQ ID NOs: 1–81, 405–485. The nucleic acid sequence may be complementary to a coding sequence of a gene whose expression is required for microorganism proliferation.

Another embodiment of the present invention is a vector comprising a promoter operably linked to a nucleic acid comprising a sequence selected from the group consisting of SEQ ID NOs. 1–81, 405–485. The promoter may be active in an organism selected from the group consisting of Escherichia coli, Staphylococcus aureus, Pseudomonas aeruginosa, Enterobacter cloacae, Helicobacter pylori, Neissera gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphlyococcus epidermidis, Mycobacterium tuberculosis, Mycobacterium leprae, Treponema pallidum, Bacillus anthracis, Yersinia pestis, Clostridium botulinum, Campylobacter jejuni, Chlamydia trachomatus, Chlamydia pneumoniae or any species falling within the genera of any of the above species.

Another embodiment of the present invention is a host cell containing the vectors described above.

Another embodiment of the present invention is a purified or isolated nucleic acid consisting essentially of the coding sequence of one of SEQ ID NOs: 82–88, 90–242. One aspect of this embodiment is a fragment of the nucleic acid comprising at least 10, at least 20, at least 25, at least 30, at least 50 or more than 50 consecutive bases of one of SEQ ID NOs: 82–88, 90–242.

Another embodiment of the present invention is a vector comprising a promoter operably linked to the nucleic acids of the preceding embodiment.

Another aspect of the present invention is a purified or isolated nucleic acid comprising a nucleic acid sequence complementary to at least a portion of an intragenic sequence, intergenic sequence, sequences spanning at least a portion of two or more genes, 5' noncoding region, or 3' noncoding region within an operon encoding a polypeptide comprising a sequence selected from the group consisting of SEQ ID NOs: 243–357, 359–398.

Another embodiment of the present invention is a purified or isolated nucleic acid comprising a nucleic acid having at least 70% homology to a sequence selected from the group consisting of SEQ ID NOs 1–81, 405–485, 82–88, 90–242 or the sequences complementary thereto as determined using BLASTN version 2.0 with the default parameters. The nucleic acid may be from an organism selected from the group consisting of Staphylococcus aureas, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, and Chlamydia trachomatis, Chlamydia pneumoniae or any species falling within the genera of any of the above species.

Another embodiment of the present invention is a purified or isolated nucleic acid consisting essentially of a nucleic acid encoding a polypeptide having a sequence selected from the group consisting of SEQ ID NOs. 243–357, 359–398.

Another embodiment of the present invention is a vector comprising a promoter operably linked to a nucleic acid encoding a polypeptide having a sequence selected from the group consisting of SEQ ID NOs.: 243–357, 359–398.

Another embodiment of the present invention is a host cell containing the vector of the preceding embodiment.

Another embodiment of the present invention is purified or isolated polypeptide comprising the sequence of one of SEQ ID NOs: 243–357, 359–398.

Another embodiment of the present invention is purified or isolated polypeptide comprising a fragment of one of the polypeptides of SEQ ID NOs. 243–357. 359–398, said fragment selected from the group consisting of fragments comprising at least 5, at least 10, at least 20, at least 30, at least 40, at least 50, at least 60 or more than 60 consecutive amino acids of one of the polypeptides of SEQ ID NOs.: 243–357, 359–398.

Another embodiment of the present invention is an antibody capable of specifically binding the polypeptide of the preceding embodiment.

Another embodiment of the present invention is method of producing a polypeptide, comprising introducing a vector comprising a promoter operably linked to a nucleic acid encoding a polypeptide having a sequence selected from the group consisting of SEQ ID NOs. 243–357, 359–398 into a cell. The method may further comprise the step of isolating said protein.

Another embodiment of the present invention is a method of inhibiting proliferation comprising inhibiting the activity or reducing the amount of a polypeptide having a sequence selected from the group consisting of SEQ ID NOs. 243–357, 359–398 or inhibiting the activity or reducing the amount of a nucleic acid encoding said polypeptide.

Another embodiment of the present invention is method for identifying compounds which influence the activity of a polypeptide required for proliferation comprising:

contacting a polypeptide comprising a sequence selected from the group consisting of 243–357, 359–398 with a candidate compound; and determining whether said compound influences the activity of said polypeptide.

The activity may be an enzymatic activity. The activity may be a carbon compound catabolism activity. The activity may be a biosynthetic activity. The activity may be a transporter activity. The activity may be a transcriptional activity. The activity may be a DNA replication activity. The activity may be a cell division activity.

Another embodiment of the present invention is a compound identified using the above method.

Another embodiment of the present invention is method for assaying compounds for the ability to reduce the activity or level of a polypeptide required for proliferation, comprising:

providing a target, wherein said target comprises the coding sequence of a sequence selected from the group consisting of SEQ ID NOs. 82–88, 90–242;

contacting said target with a candidate compound; and measuring an activity of said target.

The target may be a messenger RNA molecule transcribed from a coding region of one of SEQ ID. NOs.: 82–88, 90–242 and said activity is translation of said messenger RNA. The target may be a coding region of one of SEQ ID. NOs. 82–88, 90–242 and said activity is transcription of said messenger RNA.

Another embodiment of the present invention is a compound identified using the method above.

Another embodiment of the present invention is a method for identifying compounds which reduce the activity or level of a gene product required for cell proliferation comprising the steps of:

expressing an antisense nucleic acid against a nucleic acid encoding said gene product in a cell to reduce the activity or amount of said gene product in said cell, thereby producing a sensitized cell;

contacting said sensitized cell with a compound, and determining whether said compound inhibits the growth of said sensitized cell to a greater extent than said compound inhibits the growth of a nonsensitized cell.

The cell may be selected from the group consisting of bacterial cells, fungal cells, plant cells, and animal cells. The cell may be an *E. coli* cell. The cell may be from an organism selected from the group consisting of *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, and Chlamydia trachomatus, Chlamydia pneumoniae* or any species falling within the genera of any of the above species. The antisense nucleic acid may be transcribed from an inducible promoter. The method may, further comprise the step of contacting said cell with a concentration of inducer which induces said antisense nucleic acid to a sublethal level. The sub-lethal concentration of said inducer may be such that growth inhibition is 8% or more. The inducer may be isopropyl-1-thio-β-D-galactoside. The growth inhibition may be measured by monitoring optical density of a culture growth solution. The gene product may be a polypeptide. The gene product may be an RNA. The gene product may comprise a polypeptide having a sequence selected from the group consisting of SEQ ID NOs.: 243–357, 359–398.

Another embodiment of the present invention is a compound identified using the method above.

Another embodiment of the present invention is a method for inhibiting cellular proliferation comprising introducing a compound with activity against a gene corresponding to one of SEQ ID NOs.: 82–88, 90–242 or with activity against the product of said gene into a population of cells expressing a gene. The compound may be an antisense oligonucleotide comprising a sequence selected from the group consisting of SEQ ID NOs.: 1–81, 405–485, or a proliferation-inhibiting portion thereof. The proliferation inhibiting portion of one of SEQ ID NOs. 1–81, 405–485 may be a fragment comprising at least 10, at least 20, at least 25, at least 30, at least 50 or more than 50 consecutive bases of one of SEQ ID NOs: 1–81, 405–485. The compound may be a triple helix oligonucleotide.

Another embodiment of the present invention is a preparation comprising an effective concentration of an antisense oligonucleotide comprising a sequence selected from the group consisting of SEQ ID NOs.: 1–81, 405–485, or a proliferation-inhibiting portion thereof in a pharmaceutically acceptable carrier. The proliferation-inhibiting portion of one of SEQ ID NOs. 1–81, 405–485 may comprise at least 10, at least 20, at least 25, at least 30, at least 50 or more than 50 consecutive bases of one of SEQ ID NOs: 1–81, 405–485.

Another embodiment of the present invention is a method for inhibiting the expression of a gene in an operon required for proliferation comprising contacting a cell in a cell population with an antisense nucleic acid, said cell expressing a gene corresponding to one of SEQ ID NOs.: 82–88, 90–242, wherein said antisense nucleic acid comprises at least a proliferation-inhibiting portion of said operon in an antisense orientation that is effective in inhibiting expression of said gene. The antisense nucleic acid may be complementary to a sequence of a gene comprising one or more of SEQ ID NOs.: 82–88, 90–242. The antisense nucleic acid may be a sequence of one of SEQ ID NOs.: 1–81, 405–485, or a portion thereof. The cell may be contacted with said antisense nucleic acid by introducing a plasmid which expresses said antisense nucleic acid into said cell population. The cell may be contacted with said antisense nucleic acid by introducing a phage which expresses said antisense nucleic acid into said cell population. The cell may be contacted with said antisense nucleic acid by introducing a sequence encoding said antisense nucleic acid into the chromosome of said cell into said cell population. The cell may be contacted with said antisense nucleic acid by introducing a retron which expresses said antisense nucleic acid into said cell population. The cell may be contacted with said antisense nucleic acid by introducing a ribozyme into said cell-population, wherein a binding portion of said ribozyme is complementary to said antisense oligonucleotide. The cell may be contacted with said antisense nucleic acid by introducing a liposome comprising said antisense oligonucleotide into said cell. The cell may be contacted with said antisense nucleic acid by electroporation. The antisense nucleic acid may be a fragment comprising at least 10, at least 20, at least 25, at least 30, at least 50 or more than 50 consecutive bases of one of SEQ ID NOs: 82–88, 90–242. The antisense nucleic acid may be an oligonucleotide.

Another embodiment of the present invention is a method for identifying bacterial strains comprising the steps of:

providing a sample containing a bacterial species; and identifying a bacterial species using a species specific probe having a sequence selected from the group consisting of SEQ ID NOs. 1–81, 405–485, 82–88, 90–242.

Another embodiment of the present invention is a method for identifying a gene in a microorganism required for proliferation comprising:

(a) identifying an inhibitory nucleic acid which inhibits the activity of a gene or gene product required for proliferation in a first microorganism;

(b) contacting a second microorganism with said inhibitory nucleic acid;

(c) determining whether said inhibitory nucleic acid from said first microorganism inhibits proliferation of said second microorganism; and (d) identifying the gene in said second microorganism which is inhibited by said inhibitory nucleic acid.

Another embodiment of the present invention is a method for assaying a compound for the ability to inhibit proliferation of a microorganism comprising:

(a) identifying a gene or gene product required for proliferation in a first microorganism;

(b) identifying a homolog of said gene or gene product in a second microorganism;

(c) identifying an inhibitory nucleic acid sequence which inhibits the activity of said homolog in said second microorgansim;

(d) contacting said second microorganism with a proliferation-inhibiting amount of said inhibitory nucleic acid, thus sensitizing said second microorganism;

(e) contacting the sensitized microorganism of step (d) with a compound; and (f) determining whether said compound inhibits proliferation of said sensitized microorganism to a greater extent than said compound inhibits proliferation of a nonsensitized microorganism.

The step of identifying a gene involved in proliferation in a first microorganism may comprise:

introducing a nucleic acid comprising a random genomic fragment from said first microorganism operably linked to a promoter wherein said random genomic fragment is in the antisense orientation; and comparing the proliferation of said first microorganism transcribing a first level of said random genomic fragment to the proliferation of said first microorganism transcribing a lower level of said random genomic fragment, wherein a difference in proliferation indicates that said random genomic fragment comprises a gene involved in proliferation.

The step of identifying a homolog of said gene in a second microorganism may comprise identifying a homologous nucleic acid or a nucleic acid encoding a homologous polypeptide in a database using an algorithm selected from the group consisting of BLASTN version 2.0 with the default parameters and FASTA version 3.0t78 algorithm with the default parameters. The step of identifying a homolog of said gene in a second microorganism may comprise identifying a homologous nucleic acid or a nucleic acid encoding a homologous polypeptide by identifying nucleic acids which hybridize to said first gene. The step of identifying a homolog of said gene in a second microorganism may comprise expressing a nucleic acid which inhibits the proliferation of said first microorganism in said second microorganism. The inhibitory nucleic acid may be an antisense nucleic acid. The inhibitory nucleic acid may comprise an antisense nucleic acid to a portion of said homolog. The inhibitory nucleic acid may comprise an antisense nucleic acid to a portion of the operon encoding said homolog. The step of contacting the second microorganism with a proliferation-inhibiting amount of said nucleic acid sequence may comprise directly contacting said second microorganism with said nucleic acid. The step of contacting the second microorganism with a proliferation-inhibiting amount of said nucleic acid sequence may comprise expressing an antisense nucleic acid to said homolog in said second microorganism.

Another embodiment of the present invention is a compound identified using the method above.

Another embodiment of the present invention is a method of assaying a compound for the ability to inhibit proliferation comprising:

(a) identifying an inhibitory nucleic acid sequence which inhibits the activity of a gene or gene product required for proliferation in a first microorgansim;

(b) contacting a second microorganism with a proliferation-inhibiting amount of said inhibitory nucleic acid, thus sensitizing said second microorganism;

(c) contacting the proliferation-inhibited microorganism of step (b) with a compound; and (d) determining whether said compound inhibits proliferation of said sensitized second microorganism to a greater extent than said compound inhibits proliferation of a nonsensitized second microorganism.

The inhibitory nucleic acid may be an antisense nucleic acid which inhibits the proliferation of said first microorganism. The inhibitory nucleic acid may comprise a portion of an antisense nucleic acid which inhibits the proliferation of said first microorganism. The inhibitory nucleic acid may comprise an antisense molecule against the entire coding region of the gene involved in proliferation of the first microorganism. The inhibitory nucleic acid may comprise an antisense nucleic acid to a portion of the operon encoding the gene involved in proliferation of the first microorganism.

Another embodiment of the present invention is a compound identified using the method above.

Another embodiment of the present invention is a method for assaying compounds for activity against a biological pathway required for proliferation comprising:

sensitizing a cell by expressing an antisense nucleic acid against a nucleic acid encoding a gene product required for proliferation in a cell to reduce the activity or amount of said gene product;

contacting the sensitized cell with a compound; and determining whether said compound inhibits the growth of said sensitized cell to a greater extent than said compound inhibits the growth of an nonsensitized cell.

The cell may be selected from the group consisting of bacterial cells, fungal cells, plant cells, and animal cells. The cell may be an *E. coli* cell. The cell may be an organism selected from the group consisting of *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni,* and *Chlamydia trachomatus, Chlamydia pneumoniae* or any species falling within the genera of any of the above species. The antisense nucleic acid may be transcribed from an inducible promoter. The method may further comprise contacting the cell with an agent which induces expression of said antisense nucleic acid from said inducible promoter, wherein said antisense nucleic acid is expressed at a sublethal level. The sublethal level of said antisense nucleic acid may inhibit proliferation by 8% or more. The agent may be isopropyl-1-thio-β-D-galactoside (IPTG). The inhibition of proliferation may be measured by monitoring the optical density of a liquid culture. The gene product may comprise a polypeptide having a sequence selected from the group consisting of SEQ ID NOs: 243–357, 359–398.

Another embodiment of the present invention is a compound identified using the method above.

Another embodiment of the present invention is a method for assaying a compound for the ability to inhibit cellular proliferation comprising:

contacting a cell with an agent which reduces the activity or level of a gene product required for proliferation of said cell;

contacting said cell with said compound; and determining whether said compound reduces proliferation to a greater extent than said compound reduces proliferation of cells which have not been contacted with said agent.

The agent which reduces the activity or level of a gene product required for proliferation of said cell may comprise an antisense nucleic acid to a gene or operon required for proliferation. The agent which reduces the activity or level of a gene product required for proliferation of said cell may comprise an antibiotic. The cell may contain a temperature sensitive mutation which reduces the activity or level of said gene product required for proliferation of said cell. The antisense nucleic acid may be directed against the same functional domain of said gene product required for proliferation of said cell to which said antisense nucleic acid is directed. The antisense nucleic acid may be directed against a different functional domain of said gene product required for proliferation of said cell than the functional domain to which said antisense nucleic acid is directed.

Another embodiment of the present invention is a compound identified using the method above.

Another embodiment of the present invention is a method for identifying the pathway in which a proliferation-required nucleic acid, or its gene product lies comprising:

expressing a sublethal level of an antisense nucleic acid directed against said proliferation-required nucleic acid in a cell;

contacting said cell with an antibiotic, wherein the a biological pathway on which said antibiotic acts is known; and determining whether said cell has a substantially greater sensitivity to said antibiotic than a cell which does not express said sublethal level of said antisense nucleic acid.

Another embodiment of the present invention is a method for determining the pathway on which a test compound acts comprising:

(a) expressing a sublethal level of an antisense nucleic acid directed against a proliferation-required nucleic acid in a cell, wherein the biological pathway in which said proliferation-required nucleic acid lies is known, (b) contacting said cell with said test compound; and (c) determining whether said cell has a substantially greater sensitivity to said test compound than a cell which does not express said sublethal level of said antisense nucleic acid.

The method may further comprise:

(d) expressing a sublethal level of a second antisense nucleic acid directed against a second proliferation-required nucleic acid in said cell, wherein second proliferation-required nucleic acid is in a different biological pathway than said proliferation-required nucleic acid in step (a); and (e) determining whether said cell has a substantially greater sensitivity to said test compound than a cell which does not express said sublethal level of said second antisense nucleic acid.

Another embodiment of the present invention is a purified or isolated nucleic acid consisting essentially of one of SEQ ID NOs: 358, 399–402.

Another embodiment of the present invention is a purified or isolated nucleic acid comprising a sequence selected from the group consisting of 1–81, 405–485, 82–88, 90–242, 358, 399–402.

Another embodiment of the present invention is a compound which interacts with the gene or gene product of a nucleic acid comprising a sequence of one of SEQ ID NOs: 82–88, 90–242 to inhibit proliferation.

Another embodiment of the present invention compound which interacts with a polypeptide comprising one of SEQ ID NOs. 243–357, 359–398 to inhibit proliferation.

Another embodiment of the present invention is a compound which interacts with a nucleic acid comprising one of SEQ ID NOs: 358, 399–402 to inhibit proliferation.

DEFINITIONS

Figure 1:
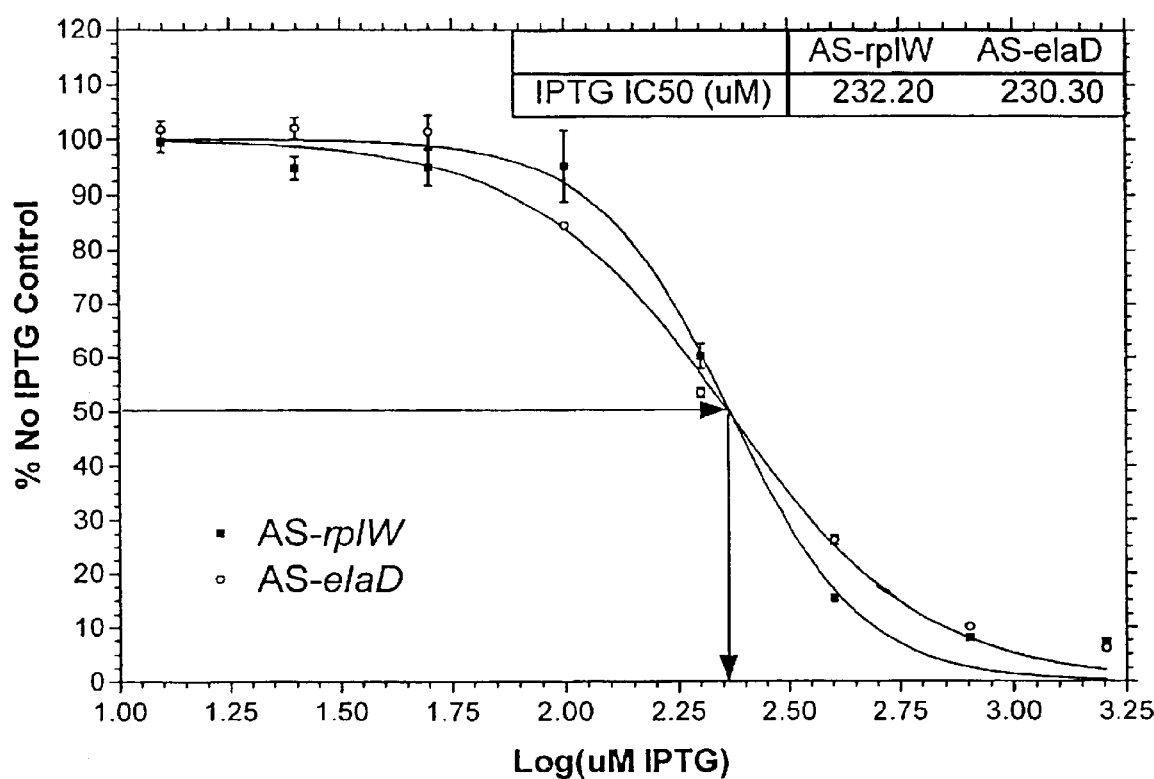
FIG. 1 is an IPTG dose response curve in E. coli transformed with an IPTG-inducible plasmid containing either an antisense clone to the E. coli ribosomal protein rplW (AS-rplW) which is required for protein synthesis and essential cell proliferation, or an antisense clone to the elaD (AS-elaD) gene which is not known to be involved in protein synthesis and which is also essential for proliferation.

By "biological pathway" is meant any discrete cell function or process that is carried out by a gene product or a subset of gene products. Biological pathways include enzymatic, biochemical and metabolic pathways as well as pathways involved in the production of cellular structures such cell walls. Biological pathways that are usually required for proliferation of microorganisms include, but are not limited to, cell division, DNA synthesis & replication, RNA synthesis (transcription), protein synthesis (translation), protein processing, protein transport, fatty acid biosynthesis, cell wall synthesis, cell membrane synthesis & maintenance, etc.

By "inhibit activity against a gene or gene product" is meant having the ability to interfere with the function of a gene or gene product in such a way as to decrease expression of the gene or to reduce the level or activity of a product of the gene. Agents which have activity against a gene include agents that inhibit transcription of the gene and agents that inhibit translation of the mRNA transcribed from the gene. In microorganisms, agents which have activity against a gene can act to decrease expression of the operon in which the gene resides or alter the processing of operon RNA such as to reduce the level or activity of the gene product. The gene product can be a non-translated RNA such as ribosomal RNA, a translated RNA (mRNA) or the protein product resulting from translation of the gene mRNA. Of particular utility to the present invention are anti-sense RNAs that have activities against the operons or genes to which they specifically hybridze.

By "activity against a gene product" is meant having the ability to inhibit the function or to reduce the level or activity of the gene product in a cell.

By "activity against a protein" is meant having the ability to inhibit the function or to reduce the level or activity of the protein in a cell.

By "activity against nucleic acid" is meant having the ability to inhibit the function or to reduce the level or activity of the nucleic acid in a cell.

As used herein, "sublethal" means a concentration of an agent below the concentration required to inhibit all cell growth.

DETAILED DESCRIPTION OF THE INVENTION

The present invention describes a group of *E. coli* genes and gene families required for growth and/or proliferation. A proliferation-required gene or gene family is one where, in the absence of a gene transcript and/or gene product, growth or viability of the microorganism is reduced or eliminated. Thus, as used herein the technology "proliferation-required" or "required for proliferation" encompasses sequences where the absence of a gene transcript and/or gene product completely eliminates cell growth as well as sequences where the absence of a gene transcript and/or gene product merely reduces cell growth. These proliferation-required genes can be used as potential targets for the generation of new antimicrobial agents. To achieve that goal, the present invention also encompasses novel assays for analyzing proliferation-required genes and for identifying compounds which interact with the gene products of the proliferation-required genes. In addition, the present invention contemplates the expression of genes and the purification of the proteins encoded by the nucleic acid sequences identified as required proliferation genes and reported herein. The purified proteins can be used to generate reagents and screen small molecule libraries or other candidate compound libraries for compounds that can be further developed to yield novel antimicrobial compounds. The present invention also describes methods for identification of homologous genes in organisms other than *E. coli*.

The present invention utilizes a novel method to identify proliferation-required *E. coli* sequences. Generally, a library of nucleic acid sequences from a given source are subcloned or otherwise inserted into an inducible expression vector, thus forming an expression library. Although the insert nucleic acids may be derived from the chromosome of the organism into which the expression vector is to be introduced, because the insert is not in its natural chromosomal location, the insert nucleic acid is an exogenous nucleic acid for the purposes of the discussion herein. The term expression is defined as the production of an RNA molecule from a gene, gene fragment, genomic fragment, or operon. Expression can also be used to refer to the process of peptide or polypeptide synthesis. An expression vector is defined as a vehicle by which a ribonucleic acid (RNA) sequence is transcribed from a nucleic acid sequence carried within the expression vehicle. The expression vector can also contain features that permit translation of a protein product from the transcribed RNA message expressed from the exogenous nucleic acid sequence carried by the expression vector. Accordingly, an expression vector can produce an RNA molecule as its sole product or the expression vector can produce a RNA molecule that is ultimately translated into a protein product.

Once generated, the expression library containing the exogenous nucleic acid sequences is introduced into an *E. coli* population to search for genes that are required for bacterial proliferation. Because the library molecules are foreign to the population of *E. coli*, the expression vectors and the nucleic acid segments contained therein are considered exogenous nucleic acid.

Expression of the exogenous nucleic acid fragments in the test population of *E. coli* containing the expression vector library is then activated. Activation of the expression vectors consists of subjecting the cells containing the vectors to conditions that result in the expression of the exogenous nucleic acid sequences carried by the expression vector library. The test population of *E. coli* cells is then assayed to determine the effect of expressing the exogenous nucleic acid fragments on the test population of cells. Those expression vectors that, upon activation and expression, negatively impact the growth of the *E. coli* screen population were identified, isolated, and purified for further study.

A variety of assays are contemplated to identify nucleic acid sequences that negatively impact growth upon expression. In one embodiment, growth in *E. coli* cultures expressing exogenous nucleic acid sequences and growth in cultures not expressing these sequences is compared. Growth measurements are assayed by examining the extent of growth by measuring optical densities. Alternatively, enzymatic assays can be used to measure bacterial growth rates to identity exogenous nucleic acid sequences of interest. Colony size, colony morphology, and cell morphology are additional factors used to evaluate growth of the host cells. Those cultures that failed to grow or grow with reduced efficiency under expression conditions are identified as containing an expression vector encoding a nucleic acid fragment that negatively affects a proliferation-required gene.

Once exogenous nucleic acid sequences of interest are identified, they are analyzed. The first step of the analysis is to acquire the nucleic acid sequence of the nucleic acid fragment of interest. To achieve this end, the insert in those expression vectors identified as containing a sequence of interest is sequenced, using standard techniques well known in the art. The next step of the process is to determine the source of the nucleic acid sequence.

Determination of sequence source is achieved by comparing the obtained sequence data with known sequences in various genetic databases. The sequences identified are used to probe these gene databases. The result of this procedure is a list of exogenous nucleic acid sequences corresponding to a list that includeds novel bacterial genes required for proliferation as well as genes previously identified as required for proliferation.

The number of DNA and protein sequences available in database systems has been growing exponentially for years. For example, at the end of 1998, the complete sequences of

*Caenorhabditis elegans, Saccharomyces cerevisiae* and nineteen bacterial genomes, including *E. coli* were available. This sequence information is stored in a number of databanks, such as GenBank (the National Center for Biotechnology Information (NCBI), and is publicly available for searching.

A variety of computer programs are available to assist in the analysis of the sequences stored within these databases. FastA, (W. R. Pearson (1990) "Rapid and Sensitive Sequence Comparison with FASTP and FASTA" Methods in Enzymology 183:63–98), Sequence Retrieval System (SRS), (Etzold & Argos, SRS an indexing and retrieval tool for flat file data libraries. Comput. Appl. Biosci. 9:49–57, 1993) are two examples of computer programs that can be used to analyze sequences of interest. In one embodiment of the present invention, the BLAST family of computer programs, which includes BLASTSN version 2.0 with the default parameters, or BLASTX version 2.0 with the default parameters, is used to analyze nucleic acid sequences.

BLAST, an acronym for "Basic Local Alignment Search Tool," is a family of programs for database similarity searching. The BLAST family of programs includes: BLASTN, a nucleotide sequence database searching program, BLASTX, a protein database searching program where the input is a nucleic acid sequence; and BLASTP, a protein database searching program. BLAST programs embody a fast algorithm for sequence matching, rigorous statistical methods for judging the significance of matches, and various options for tailoring the program for special situations.

Bacterial genes are often transcribed in polycistronic groups. These groups comprise operons, which are a collection of genes and intergenic sequences. The genes of an operon are co-transcribed and are often related functionally. Given the nature of the screening protocol, it is possible that the identified exogenous nucleic acid sequence corresponds to a gene or portion thereof with or without adjacent noncoding sequences, an intragenic sequence (i.e. a sequence within a gene), an intergenic sequence (i.e. a sequence between genes), a sequence spanning at least a portion of two or more genes, a 5' noncoding region or a 3' noncoding region located upstream or downstream from the actual sequence that is required for bacterial proliferation. Accordingly, determining which of the genes that are encoded within the operons are individually required for proliferation is often desirable.

In one embodiment of the present invention, an operon is dissected to determine which gene or genes are required for proliferation. For example, the RegulonDB DataBase described by Huerta et al. (*Nucl. Acids Res.* 26:55–59, 1998), may be used, to identify the boundaries of operons encoded within microbial genomes. The Regulon DB database can be accessed on the internet by entering the following quoted text. "www.cif.unam.", in the address bar of a web browser, such as Internet Explorer or Netscape, followed immediately by "mx/Computational Biology/regulondb/". A number of techniques that are well known in the art can be used to dissect the operon. In one aspect of this embodiment, gene disruption by homologous recombination is used to individually inactivate the genes of an operon that is thought to contain a gene required for proliferation.

Several gene disruption techniques have been described for the replacement of a functional gene with a mutated, non-functional (null) allele. These techniques generally involve the use of homologous recombination. The method described by Link et al. (J. Bacteriol 1997 179:6228; incorporated herein by reference in it's entirety) serves as an excellent example of these methods as applicable to disruption of genes in *E. coli*. This technique uses crossover PCR to create a null allele with an in-frame deletion of the coding region of a target gene. The null allele is constructed in such a way that sequences adjacent to the wild type gene (ca. 500 bp) are retained. These homologous sequences surrounding the deletion null allele provide targets for homologous recombination so that the wild type gene on the *E. coli* chromosome can be replaced by the constructed null allele.

The crossover PCR amplification product is subcloned into the vector pKO3, the features of which include a chloramphenicol resistance gene, the counter-selectable marker sacB, and a temperature sensitive autonomous replication function. Following transformation of an *E. coli* cell population with such a vector, selection for cells that have undergone homologous recombination of the vector into the chromosome is achieved by growth on chloramphenicol at the non-permissive temperature of 43° C. Under these conditions, autonomous replication of the plasmid cannot occur and cell are resistant to chloramphinicol only if the chloramphenicol resistance gene has been integrated into the chromosome. Usually a single crossover event is responsible for this integration event such that the *E. coli* chromosome now contains a tandem duplication of the target gene consisting of one wild type allele and one deletion null allele separated by vector sequence.

This new *E. coli* strain containing the tandem duplication can be maintained at permissive temperatures in the presence of drug selection (chloramphenicol). Subsequently, cells of this new strain are cultured at the permissive temperature 30° C. without drug selection. Under these conditions, the chromosome of some of the cells within the population will have undergone an internal homologous recombination event resulting in removal of the plasmid sequences. Subsequent culturing of the strain in growth medium lacking chloramphenicol but containing sucrose is used to select for such recombinative resolutions. In the presence of the counter-selectable marker sacB, sucrose is rendered into a toxic metabolite. Thus, cells that survive this counter-selection have lost both the plasmid sequences from the chromosome and the autonomously replicating plasmid that results as a byproduct of recombinative resolution.

There are two possible outcomes of the above recombinative resolution via homologous recombination. Either the wild type copy of the targeted gene is retained on the chromosome or the mutated null allele is retained on the chromosome. In the case of an essential gene, a single copy of the null allele would be lethal and such cells should not be obtained by the above procedure when applied to essential genes. In the case of a non-essential gene, roughly equal numbers of cells containing null alleles and cells containing wild type alleles should be obtained. Thus, the method serves as a test for essentiality of the targeted gene: when applied to essential genes; only cells with a wild type allele on the chromosome will be obtained.

Other techniques have also been described for the creation of disruption mutations in *E. coli*. For example, Link et al. also describe inserting an in-frame sequence tag concomitantly with an in-frame deletion in order to simplify analysis of recombinants obtained. Further, Link et al. describe disruption of genes with a drug resistance marker such as a kanamycin resistance gene. Arigoni et al., (Arigoni, F. et al. A Genome-based Approach for the Identification of Essential Bacterial Genes, Nature Biotechnology 16: 851–856, the disclosure of which is incorporated herein by reference in its entirety) describe the use of gene disruption combined with engineering a second copy of a test gene such that the expression of the gene is regulated by and inducible promoter such as the arabinose promoter to test the essentiality of the gene. Many of these techniques result in the insertion of large fragments of DNA into the gene of interest, such as a drug selection marker. An advantage of the technique described by Link et al. is that it does not rely on an insertion into the gene to cause a functional defect, but rather results in the precise removal of the coding region. This insures the lack of polar effects on the expression of genes downstream from the target gene.

Recombinant DNA techniques can be used to express the entire coding sequences of the gene identified as required for proliferation, or portions thereof. The over-expressed proteins can be used as reagents for further study. The identified exogenous sequences are isolated, purified, and cloned into a suitable expression vector using methods well known in the art. If desired, the nucleic acids can contain the sequences encoding a signal peptide to facilitate secretion of the expressed protein.

Expression of fragments of die bacterial genes identified as required for proliferation is also contemplated by the present invention. The fragments of the identified genes can encode a polypeptide comprising at least 5, at least 10, at least 15, at least 20, at least 25, at least 30, at least 35, at least 40, at least 45, at least 50, at least 55, at least 60, at least 65, at least 75, or more than 75 consecutive amino acids of a gene complementary to one of the identified sequences of the present invention. The nucleic acids inserted into the expression vectors can also contain sequences upstream and downstream of the coding sequence.

When expressing the coding sequence of an entire gene identified as required for bacterial proliferation or a fragment thereof, the nucleic acid sequence to be expressed is operably linked to a promoter in an expression vector using conventional cloning technology. The expression vector can be any of the bacterial, insect, yeast, or mammalian expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon usage and codon bias of the sequence can be optimized for the particular expression organism in which the expression vector is introduced, as explained by Hatfield, et al., U.S. Pat. No. 5,082,767, incorporated herein by, this reference. Fusion protein expression systems are also contemplated by the present invention.

Following expression of the protein encoded by the identified exogenous nucleic acid sequence, the protein is purified. Protein purification techniques are well known in the art. Proteins encoded and expressed from identified exogenous nucleic acid sequences can be partially purified using precipitation techniques, such as precipitation with polyethylene glycol. Chromatographic methods usable with the present invention can include ion-exchange chromatography, gel filtration, use of hydroxyapaptite columns, immobilized reactive dyes, chromatofocusing, and use of high-performance liquid chromatography. Electrophoretic methods such one-dimensional gel electrophoresis, high-resolution two-dimensional polyacrylamide electrophoresis, isoelectric focusing, and others are contemplated as purification methods. Also, affinity chromatographic methods, comprising antibody columns, ligand presenting columns and other affinity chromatographic matrices are contemplated as purification methods in the present invention.

The purified proteins produced from the gene coding sequences identified as required for proliferation can be used in a variety of protocols to generate useful antimicrobial reagents. In one embodiment of the present invention, antibodies are generated against the proteins expressed from the identified exogenous nucleic acid sequences. Both monoclonal and polyclonal antibodies can be generated against the expressed proteins. Methods for generating monoclonal and polyclonal antibodies are well known in the art. Also, antibody fragment preparations prepared from the produced antibodies discussed above are contemplated.

Another application for the purified proteins of the present invention is to screen small molecule libraries for candidate compounds active against the various target proteins of the present invention. Advances in the field of combinatorial chemistry provide methods, well known in the art, to produce large numbers of candidate compounds that can have a binding, or otherwise inhibitory effect on a target protein. Accordingly, the screening of small molecule libraries for compounds with binding affinity or inhibitory activity for a target protein produced from an identified gene sequence is contemplated by the present invention.

The present invention further contemplates utility against a variety of other pathogenic organisms in addition to *E. coli*. For example, the invention has utility in identifying genes required for proliferation in prokaryotes and eukaryotes. For example, the invention has utility with protists, such as Plasmodium spp.; plants, animals, such as Entamoeba spp. and Contracaecum spp; and fungi including Candida spp., (e.g. *Candida albicans*), *Saccharomyces cerevisiae, Cryptococcus neoformans,* and *Aspergillus fumigatus*. In one embodiment of the present invention, monera, specifically bacteria are probed in search of novel gene sequences required for proliferation. This embodiment is particularly important given the rise of drug resistant bacteria.

The numbers of bacterial species that are becoming resistant to existing antibiotics are growing. A partial list of these organisms includes: Staphylococcus spp., such as *S. aureus;* Enterococcus spp., such as *E. faecalis;* Pseudomonas spp., such as *P. aeruginosa,* Clostridium spp., such as *C. botulinum,* Haemophilus spp., such as *H. influenzae,* Enterobacter spp., such as *E. cloacae,* Vibrio spp., such as *V. cholera;* Moraxala spp., such as *M. catarrhalis;* Streptococcus spp. such as *S. pneumonia,* Neisseria spp., such as *N. gonorrhoeae;* Mycoplasma spp., such as *Mycoplasma pneumoniae; Salmonella typhimurium; Helicobacter pylori; Escherichia coli:* and *Mycobacterium tuberculosis.* The sequences identified as required for proliferation in the present invention can be used to probe these and other organisms to identify homologous required proliferation genes contained therein.

In one embodiment of the present invention, the nucleic acid sequences disclosed herein are used to screen genomic, libraries generated from bacterial species of interest other than *E. coli*. For example, the genomic library may be from *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, Chlamydia trachomatus, Chlamydia pneu-*

*moniae* or any species falling within the genera of any of the above species. Standard molecular biology techniques are used to generate genomic libraries from various microorganisms. In one aspect, the libraries are generated and bound to nitrocellulose paper. The identified exogenous nucleic acid sequences of the present invention can then be used as probes to screen the libraries for homologous sequences. The homologous sequences identified can then be used as targets for the identification of new, antimicrobial compounds with activity against more than one organism.

For example, the preceding methods may be used to isolate nucleic acids having a sequence with at least 97%, at least 95%, at least 90%, at least 85%, at least 80%, or at least 70% identity to a nucleic acid, sequence selected from the group consisting of one of the sequences of SEQ ID NOS. 1–81, 405–485, 82–88, 90–242, fragments comprising at least 10, 15, 20, 25, 30, 35, 40, 50, 75, 100, 150, 200, 300, 400, or 500 consecutive bases thereof, and the sequences complementary thereto. Identity may be measured using BLASTN version 2.0 with the default parameters. (Altschul, S. F. et al. Gapped, BLAST and PSI-BLAST: A New Generation of Protein Database Search Programs, Nucleic Acid Res. 25: 3389–3402 (1997), the disclosure of which is incorporated herein by reference in its entirety). For example, the homologous polynucleotides may have a coding sequence which is a naturally occurring allelic variant of one of the coding sequences described herein. Such allelic variants may have a substitution, deletion or addition of one or more nucleotides when compared to the nucleic acids of SEQ ID NOs: 1–81, 405–485, 82–88, 90–242 or the sequences complementary thereto.

Additionally, the above procedures may be used to isolate nucleic acids which encode polypeptides having at least 99%, 95%, at least 90%, at least 85%, at least 80%, at least 70%, at least 60%, at least 50%, or at least 40% identity or similarity to a polypeptide having the sequence of one of SEQ ID NOs: 243–357, 359–398or fragments comprising at least 5, 10, 15, 20, 25, 30, 35, 40, 50, 75, 100, or 150 consecutive amino acids thereof as determined using the FASTA version 3.0t78 algorithm with the default parameters. Alternatively, protein identity or similarity may be identified using BLASTP with the default parameters, BLASTX with the default parameters, or TBLASTN with the default parameters. (Alschul. S. F. et al. Gapped BLAST and PSI-BLAST: A New Generation of Protein Database Search Programs, Nucleic Acid Res. 25: 3389–3402 (1997), the disclosure of which is incorporated herein by reference in its entirety).

Alternatively, homologous nucleic acids or polypeptides may be identified by searching a database to identify sequences having a desired level of homology to a nucleic acid or polypeptide involved in proliferation or an antisense nucleic acid to a nucleic acid involved in microbial proliferation. A variety of such databases are available to those skilled in the art, including GenBank and GenSeq. In some embodiments, the databases are screened to identify nucleic acids or polypeptides having at least 97%, at least 95%, at least 90%, at least 85%, at least 80%, at least 70%, at least 60%, or at least 50%, at least 40% identity or similarity to a nucleic acid or polypeptide involved in proliferation or an antisense nucleic acid involved in proliferation. For example, the database may be screened to identify nucleic acids homologous to one of SEQ ID Nos. 1–81, 405–485, 82–88, 90–242 or polypeptides homologous to SEQ ID NOs. 243–357, 359–398. In some embodiments, the database may be screened to identify homologous nucleic acids or polypeptides from organisms other than *E. coli*, including organisms such as *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, Chlamydia trachomatus, Chlamydia pneumoniae* or any species falling within the genera of any of the above species.

In another embodiment, gene expression arrays and microarrays can be employed. Gene expression arrays are high density arrays of DNA samples deposited at specific locations on a glass chip, nylon membrane, or the like. Such arrays can be used by researchers to quantify relative gene expression under different conditions. Gene expression arrays are used by researchers to help identify optimal drug targets, profile new compounds, and determine disease pathways. An example of this technology is found in U.S. Pat. No. 5,807,522, which is hereby incorporated by reference.

It is possible to study the expression of all genes in the genome of a particular microbial organism using a single array. For example, the arrays from Genosys consist of 12×24 cm nylon filters containing PCR products corresponding to 4290 ORFs from *E coli*. 10 ngs of each are spotted every 1.5 mm on the filter. Single stranded labeled cDNAs are prepared for hybridization to the array (no second strand synthesis or amplification step is done) and placed in contact with the filter. Thus the labeled cDNAs are of "antisense" orientation. Quantitative analysis is done by phosphorimager.

Hybridization of cDNA made from a sample of total cell mRNA to such an array followed by detection of binding by one or more of various techniques known to those in the art results in a signal at each location on the array to which cDNA hybridized. The intensity of the hybridization signal obtained at each location in the array thus reflects the amount of mRNA for that specific gene that was present in the sample. Comparing the results obtained for mRNA isolated from cells grown under different conditions thus allows for a comparison of the relative amount of expression of each individual gene during growth under the different conditions.

Gene expression arrays may be used to analyze the total mRNA expression pattern at various time points after induction of an antisense nucleic acid against a proliferation-required gene. Analysis of the expression pattern indicated by hybridization to the array provides information on whether or not the target gene of the antisense nucleic acid is being affected by antisense induction, how quickly the antisense is affecting the target gene, and for later timepoints, what other genes are affected by antisense expression. For example, if the antisense is directed against a gene for ribosomal protein L7/L12 in the 50S subunit, its targeted mRNA may disappear first and then other mRNAs may be observed to increase, decrease or stay the same. Similarly, if the antisense is directed against a different 50S subunit ribosomal protein mRNA (e.g. L25), that mRNA may disappear first followed by changes in mRNA expression that are similar to those seen with the L7/L12 antisense expression. Thus, the mRNA expression pattern observed with an antisense nucleic acid against a proliferation required gene may identify other proliferation-required nucleic acids in the same pathway as the target of the antisense nucleic acid. In addition, the mRNA expression patterns observed with candidate drug compounds may be compared to those observed with antisense nucleic acids against a proliferation-required nucleic acid. If the mRNA expression pattern observed with the candidate drug compound is similar to that observed with the antisense nucleic acid, the drug compound may be a promising therapeutic candidate. Thus, the assay would be useful in assisting in the selection of candidate drug compounds for use in screening methods such as those described below.

In cases where the source of nucleic acid deposited on the array and the source of the nucleic acid being hybridized to the array are from two different organisms, gene expression arrays can identify homologous genes in the two organisms.

The present invention also contemplates additional methods for screening other microorganisms for proliferation-required genes. In this embodiment, the conserved portions of sequences identified as proliferation-required can be used to generate degenerate primers for use in the polymerase chain reaction (PCR). The PCR technique is well known in the art. The successful production of a PCR product using degenerate probes generated from the sequences identified herein would indicate the presence of a homologous gene sequence in the species being screened. This homologous gene is then isolated, expressed, and used as a target for candidate antibiotic compounds. In another aspect of this embodiment, the homologous gene is expressed in an autologous organism or in a heterologous organism in such a way as to alter the level or activity of a homologous gene required for proliferation in the autologous or heterologous organism. In still another aspect of this embodiment, the homologous gene or portion is expressed in an antisense orientation in such a way as to alter the level or activity of a nucleic acid required for proliferation of an autologous or heterologous organism.

The homologous sequences to proliferation-required genes identified using the techniques described herein may be used to identify proliferation-required genes of organisms other than *E. coli*, to inhibit the proliferation of organisms other than *E. coli* by inhibiting the activity or reducing the amount of the identified homologous nucleic acid or polypeptide in the organism other than *E. coli* or to identify compounds which inhibit the growth of organisms other than *E. coli* as described below.

In another embodiment of the present invention, *E. coli* sequences identified as required for proliferation are transferred to expression vectors capable of function within non-*E. coli* species. As would be appreciated by one of ordinary skill in the art, expression vectors must contain certain elements that are species specific. These elements can include promoter sequences, operator sequences, repressor genes, origins of replication, ribosomal binding sequences, termination sequences, and others. To use the identified exogenous sequences of the present invention, one of ordinary skill in the art would know to use standard molecular biology techniques to isolate vectors containing the sequences of interest from cultured bacterial cells, isolate and purify those sequences, and subclone those sequences into an expression vector adapted for use in the species of bacteria to be screened.

Expression vectors for a variety of other species are known in the art. For example, Cao et al. report the expression of steroid receptor fragments in *Staphylococcus aureus*. J. Steroid Biochem Mol Biol. 44(1):1–11 (1993). Also, Pla et al. have reported an expression vector that is functional in a number of relevant hosts including: *Salmonella typhimurium, Pseudomonas putida,* and *Pseudomonas aeruginosa.* J. Bacteriol. 172(8):4448–55 (1990). These examples demonstrate the existence of molecular biology techniques capable of constructing expression vectors for the species of bacteria of interest to the present invention.

Following the subcloning of the identified nucleic acid sequences into an expression vector functional in the microorganism of interest, the identified nucleic acid sequences are conditionally transcribed to assay for bacterial growth inhibition. Those expression vectors found to contain sequences that, when transcribed, inhibit bacterial growth are compared to the known genomic sequence of the pathogenic microorganism being screened or, if the homologous sequence from the organism being screened is not known, it may be identified and isolated by hybridization to the proliferation-required *E. coli* sequence interest or by amplification using primers based on the proliferation-required *E. coli* sequence of interest as described above.

The antisense sequences from the second organism which are identified as described above may then be operably linked to a promoter, such as an inducible promoter, and introduced into the second organism. The techniques described herein for identifying *E. coli* genes required for proliferation may thus be employed to determine whether the identified sequences from a second organism inhibit the proliferation of the second organism.

Antisense nucleic acids required for the proliferation of organisms other than *E. coli* or the genes corresponding thereto, may also be hybridized to a microarray containing the *E. coli* ORFs to gauge the homology between the *E. coli* sequences and the proliferation-required nucleic acids from other organisms. For example, the proliferation-required nucleic acid may be from *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni,* or *Chlamydia trachomatus, Chlamydia pneumoniae* or any species falling within the genera of any of the above species. The proliferation-required nucleic acids from an organism other than *E. coli* may be hybridized to the array under a variety of conditions which permit hybridization to occur when the probe has different levels of homology to the sequence on the microarray. This would provide an indication of homology across the organisms as well as clues to other possible essential genes in these organisms.

In still another embodiment, the exogenous nucleic acid sequences of the present invention that are identified as required for bacterial growth or proliferation can be used as antisense therapeutics for killing bacteria. The antisense sequences can be directed against the proliferation-required genes whose sequence corresponds to the exogenous nucleic acid probes identified here (i.e., the antisense nucleic acid may hybridize to the gene or a portion thereof). Alternatively, antisense therapeutics can be directed against operons in which proliferation-required genes reside (i.e. the antisense nucleic acid may hybridize to any gene in the operon in which the proliferation-required genes reside). Further, antisense therapeutics can be directed against a proliferation-required gene or portion thereof with or without adjacent noncoding sequences, an intragenic sequence (i.e. a sequence within a gene), an intergenic sequence (i.e. a sequence between genes), a sequence spanning at least a portion of two or more genes, a 5' noncoding region or a 3' noncoding region located upstream or downstream from the actual sequence that is required for bacterial proliferation or an operon containing a proliferation-required gene.

In addition to therapeutic applications, the present invention encompasses the use of nucleic acid sequences complementary to sequences required for proliferation as diagnostic tools. For example, nucleic acid probes complementary to proliferation-required sequences that are specific for particular species of microorganisms can be used as probes to identify particular microorganism species in clinical specimens. This utility provides a rapid and dependable method by which to identify the causative agent or agents of a bacterial infection. This utility would provide clinicians the ability to prescribe species specific antimicrobial compounds to treat such infections. In an extension of this utility, antibodies generated against proteins translated from mRNA transcribed from proliferation-required sequences can also be used to screen for specific microorganisms that produce such proteins in a species-specific manner.

The following examples teach the genes of the present invention and a subset of uses for the E. coli genes identified as required for proliferation. These examples are illustrative only and are not intended to limit the scope of the present invention.

EXAMPLES

The following examples are directed to the identification and exploitation of E. coli genes required for proliferation. Methods of gene identification are discussed as well as a variety of methods to utilize the identified sequences.

Genes Identified as Required for Proliferation of E. coli

Exogenous nucleic acid sequences were cloned into an inducible expression vector and assayed for growth inhibition activity. Example 1 describes the examination of a library of exogenous nucleic acid sequences cloned into IPTG-inducible expression vectors. Upon activation or induction, the expression vectors produced an RNA molecule corresponding to the subcloned exogenous nucleic acid sequences. The RNA product was in an antisense orientation with respect to the E. coli genes from which it was originally derived. This antisense RNA then interacted with sense mRNA produced from various E. coli genes and interfered with or inhibited the translation of the sense messenger RNA (mRNA) thus preventing protein production from these sense mRNA molecules. In cases where the sense mRNA encoded a protein required for the proliferation, bacterial cells containing an activated expression vector failed to grow or grew at a substantially reduced rate.

Example 1
Inhibition of Bacterial Proliferation After IPTG Induction

To study the effects of transcriptional induction in liquid medium, growth curves were carried out by back diluting cultures 1:200 into fresh media with or without 1 mM IPTG and measuring the $OD_{450}$ every 30 minutes (min). To study the effects of transcriptional induction on solid medium, $10^2$, $10^3$, $10^4$, $10^5$, $10^6$, $10^7$ and $10^8$ fold dilutions of overnight cultures were prepared. Aliquots of from 0.5 to 3 µl of these dilutions were spotted on selective agar plates with or without 1 mM IPTG. After overnight incubation, the plates were compared to assess the sensitivity of the clones to IPTG.

Of the numerous clones tested, some clones were identified as, a containing sequence that inhibited E. coli growth after IPTG induction. Accordingly, the gene to which the inserted nucleic acid sequence corresponds, or a gene within the operon containing the inserted nucleic acid, may be required for proliferation in E. coli.

Characterization of Isolated Clones Negatively Affecting E. coli Proliferation

Following the identification of those expression vectors that, upon expression, negatively impacted E. coli growth or proliferation, the inserts or nucleic acid fragments contained in those expression vectors were isolated for subsequent characterization. Expression vectors of interest were subjected to nucleic acid sequence determination.

Example 2
Nucleic Acid Sequence Determination of Identified Clones Expressing Nucleic Acid Fragments with Detrimental Effects of E. coli Proliferation The nucleotide sequences for the exogenous identified sequences were determined using plasmid DNA isolated using QIAPREP (Qiagen, Valencia, Calif.) and methods supplied by the manufacturer. The primers used for sequencing the inserts were 5'-TGTTTATCAGACCGCTT-3' (SEQ ID NO: 403) and 5'-ACAATTTCACACAGCCTC-3' (SEQ ID. NO: 404). These sequences flank the polylinker in pLEX5BA. Sequence identification numbers (SEQ ID NOs) for the identified inserts are listed in Table I and discussed below.

Example 3
Comparison of Isolated Sequences to Known Sequences

The nucleic acid sequences of the subcloned fragments obtained from the expression vectors discussed above were compared to known E. coli sequences in GenBank using BLAST version 1.4 or version 2.0.6 using the following default parameters: Filtering off, cost to open a gap=5, cost to extend a gap=2, penalty for a mismatch in the blast portion of run=−3, reward for a match in the blast portion of run=1, expectation value (e)=10.0, word size=11, number of one-line descriptions=100, number of alignments to show (B)=100. BLAST is described in Altschul, J Mol Biol. 215:403–10 (1990), the disclosure of which is incorporated herein by reference in its entirety. Expression vectors were found to contain nucleic acid sequences in both the sense and antisense orientations. The presence of known genes, open reading frames, and ribosome binding sites was determined by comparison to public databases holding genetic information and various computer programs such as the Genetics Computer Group programs FRAMES and CODONPREFERENCE. Clones were designated as "antisense" if the cloned fragment was oriented to the promoter such that the RNA transcript produced was complementary to the expressed mRNA from a chromosomal locus. Clones were designated as "sense" if they coded for an RNA fragment that was identical to a portion of a wild type mRNA from a chromosomal locus.

The sequences described in Examples 1–2 that inhibited bacterial proliferation and contained gene fragments in an antisense orientation are listed in Table I. This table lists each identified sequence by: a sequence identification number; a Molecule Number; a gene to which the identified sequence corresponds, listed according to the National Center for Biotechnology Information (NCBI), Blattner (Science 277:1453–1474(1997); also contains the E. coli K-12 genome sequence), or Rudd (Micro. and Mol. Rev. 62:985–1019 (1998)), (both papers are hereby incorporated by reference) nomenclatures. The CONTIG numbers for each identified sequence is shown, as well as the location of the first and last base pairs located on the *E. coli* chromosome. A Molecule Number faith a indicates a clone corresponding to an intergenic sequence.

The sequences of the nucleic acid inserts of SEQ ID NOs: 1–81 from U.S. Provisional Patent Application No. 60/117,405 which inhibited proliferation were further analyzed. The reanalyzed sequences corresponding to SEQ ID NOs. 1–81 of U.S. Provisional Patent Application No. 60/117,405 have SEQ ID NOs. 405–485 in the present application.

SEQ ID NOs: 82–242 in U.S. Provisional Patent Application No. 60/117,405 are identical to SEQ ID NOs: 82–242 of the present application with the following exceptions. SEQ ID NO: 148 in the present application is the complementary strand of SEQ ID NO: 148 in U.S. Provisional Patent Application No. 60/117,405. Accordingly, the protein of SEQ ID NO: 308 which is encoded by SEQ ID NO: 148 has also been revised. SEQ ID NO: 163 in the present application is the complementary strand of SEQ ID NO: 163 in U.S. Provisional Patent Application No. 60/117,405. Accordingly, the protein of SEQ ID NO: 323 which is encoded by SEQ ID NO: 163 has also been revised.

The target gene of SEQ ID NOs. 18 and 19 of U.S. Provisional Patent Application No. 60/117,405 (SEQ ID NOs. 18, 19, 422, 423 of the present application) has been revised from dicF to ftsZ to reflect the fact that these SEQ ID NOs. include natural antisense molecules which inhibit ftsZ expression.

The gene products of the nucleic acids of SEQ ID NOs. 198 and 239–242 in U.S. Provisional Patent Application No. 60/117,405 and in the present application (SEQ ID NOs. 358 and 399–402 of the present application) have been revised to reflect the fact that these nucleic acids encode nontranslated tRNAs and rRNAs Tables I and II have been revised accordingly. The SEQ ID NOs. in Table II were also revised to reflect the fact that SEQ ID NOs: 89 and 402 were identical in U.S. Provisional Patent Application No. 60/117,405.

TABLE I

Identified Clones with Corresponding Genes and Operons

| SEQ ID NO. | Molecule No. | Gene (NCBI) | Gene (Blattner) | Gene (Rudd) | CONTIG |
| --- | --- | --- | --- | --- | --- |
| 1, 405 | EcXA001 | yhhQ | h3471 | yhhQ | AE000423 |
| 2, 406 | EcXA002 | lepB | lepB | lepB | AE000343 |
| 3, 407 | EcXA003 | f586 | h0955 | yehZ | AE000197 |
| 4, 408 | EcXA004 | rpsG, rpsL | b3341 | rspG, rpsL | AE000410 |
| 5, 409 | EcXA005a | rplL, rplJ | b3986 | rplL, rplJ | AE000472 |
| 6, 410 | EcXA005b | rplL | rplL | rplL | AE000472 |
| 7, 411 | EcXA005c | rplL, rplJ | rplL, rplJ | rplL, rplJ | AE000472 |
| 8, 412 | EcXA005d | rplL, rplJ | rplL, rplJ | rplL, rplJ | AE000472 |
| 9, 413 | EcXA005e | rplL | rplL | rplL | AE000472 |
| 10, 414 | EcXA005f | rplL | rplL | rplL | AE000472 |
| 11, 415 | EcXA005g | rplL | rplL | rplL | AE000472 |
| 12, 416 | EcXA006 | pta | h2297 | pta | AE000319 |
| 13, 417 | EcXA007 | yicP | b3666 | yicP | AE000444 |
| 14, 418 | EcXA008a | yhaU | b3127 | yhaU | AE000394 |
| 15, 419 | EcXA008b | yhaU | yhaU | yhaU | AE000394 |
| 16, 420 | EcXA008c | yhaU | yhaU | yhaU | AE000394 |
| 17, 421 | EcXA009 | ydeY | ydeY | ydeY | AE000249 |
| 18, 422 | EcXA010a (natural as) | dicF | h1575 | dicF | AE000253 |
| 19, 423 | EcXA010b | dicF | dicF | dicF | AE000253 |
| 20, 424 | EcXA011 | fdnG | b1474 | fdnG | AE000244 |
| 21, 425 | EcXA012a | fusA | b3340 | fusA | AE000410 |
| 22, 426 | EcXA012b | fusA | fusA | fusA | AE000410 |
| 23, 427 | EcXA012c | fusA | fusA | fusA | AE000410 |
| 24, 428 | EcXA013a | o86 | b2562 | yfhL | AE000342 |
| 25, 429 | EcXA013b | o86 | b2562 | yfhL | AE000342 |
| 26, 430 | EcXA013c | o86 | b2562 | yfhL | AE000342 |
| 27, 431 | EcXA014 | visC | b2906 | visC | AE000374 |
| 28, 432 | EcXA015 | yfdI | yfdI | yfdI | AE000323 |
| 29, 433 | EcXA016 | yeaQ yoaG | yeaQ yoaG | yeaQ yoaG | AE000274 |
| 30, 434 | EcXA017a | yggE | b2922 | yggE | AE000375 |
| 31, 435 | EcXA017b | yggE | yggE | yggE | AE000375 |
| 32, 436 | EcXA018a | o464 | b2074 | yegM | AE000297 |
| 33, 437 | EcXA018b | o464 | b2074 | yegM | AE000297 |
| 34, 438 | EcXA019a | yehA | yehA | yehA | AE000300 AE000299 |
| 35, 439 | EcXA019b | o172, yehA | o172, yehA | o172, yehA | AE000299 |
| 36, 440 | EcXA020 | o384, f82 | b1794, b1795 | yeaP, yeaQ | AE000274 |
| 37, 441 | EcXA021a | f112 | b0218 | yafU | AE000130 |
| 38, 442 | EcXA021b | f112 | b0218 | yafU | AE000130 |
| 39, 443 | EcXA022 | o740 | b1629 | ydgN | AE000258 |
| 40, 444 | EcXA023a | f176, f382 | b1504, b1505 | ydeS, ydeT | AE000247 |

TABLE I-continued

Identified Clones with Corresponding Genes and Operons

| SEQ ID NO. | Molecule No. | Gene (NCBI) | Gene (Blattner) | Gene (Rudd) | CONTIG |
|---|---|---|---|---|---|
| 41, 445 | EcXA023b | f176, f382 | b1504, b1505 | ydeS, ydeT | AE000247 |
| 42, 446 | EcXA024 | ygjM, ygjN | b3082 | ygjM, ygjN | AE000390 |
| 43, 447 | EcXA025 | o2383 | b1878 | yccJ | AE000289 |
| 44, 448 | EcXA026 | o61 | Unpredicted | Unpredicted | AE000138 |
| 45, 449 | EcXA027a | yohH | yohH | yohH | AE000303 |
| 46, 450 | EcXA027b | yohH | yohH | yohH | AE000303 |
| 47, 451 | EcXA027c | yohH yohI | yohH yohI | yohH yohI | AE000303 |
| 48, 452 | EcXA027d | yohH | yohH | yohH | AE000303 |
| 49, 453 | EcXA028 | f296 | b2305 | yfeI | AE000319 |
| 50, 454 | EcXA029 | yjjK | b4391 | yjjK | AE000509 |
| 51, 455 | EcXA030 | yi5A | b3557 | yi5A | AE000433 |
| 52, 456 | EcXA031 | rplE | b3308 | rplE | AE000408 |
| 53, 457 | EcXA032a | ybgD | ybgD | ybgD | AE000175 |
| 54, 458 | EcXA032b** | ybgD gltA | ybgD gltA | ybgD gltA | AE000175 |
| 55, 459 | EcXA033a | f477 (as) | b3052 | waaE | AE000387 AE000386 |
| 56, 460 | EcXA033b | f477 | b3052 | waaE | AE000387 |
| 57, 461 | EcXA034a | espA | b3556 | espA | AE000433 |
| 58, 462 | EcXA034b | espA | b3556 | espA | AE000433 |
| 59, 463 | EcXA035 | yhjU | yhjU | yhjU | AE000431 |
| 60, 464 | EcXA036 | yqjF o99 | b3101 b3100, | yqjF yqjK | AE000392 |
| 61, 465 | EcXA037 | ydeH | b1535 | ydeH | AE000251 |
| 62, 466 | EcXA038 | sieB | b1353 | sieB | AE000233 |
| 63, 467 | EcXA039 | ybbD | ybbD | ybbD | AE000156 |
| 64, 468 | EcXA040 | InsB_6 | b3445 | insB_6 | AE000420 |
| 65, 469 | EcXA041 | f234 | b1138 | ymfE | AE000214 |
| 66, 470 | EcXA042a | rplY | rplY | rplY | AE000308 |
| 67, 471 | EcXA042b | rplY | rplY | rplY | AE000308 |
| 68, 472 | EcXA043 | ybgB cydA | ybgB cydA | ybgB cydA | AE000176 |
| 69, 473 | EcXA044 | purB | b1131 | purB | AE000213 |
| 70, 474 | EcXA045** | csrA serV | csrA serV | csrA serV | AE000353 |
| 71, 475 | EcXA046* | fimE, fimA | b4313 | fimE, fimA | AE000502 |
| 72, 476 | EcXA047* | f96, cspB | f96, cspB | cspB, ydfS | AE000252 |
| 73, 477 | EcXA048 | yefE | yefE | yefE | AE000294 |
| 74, 478 | EcXA049 | yaiC | b0385 | yaiC | AE000145 |
| 75, 479 | EcXA050 | o467, o222 | yaiU, yaiV | yaiU, yaiV | AE000144 |
| 76, 480 | EcXA051a | rplB, rplW | rplB, rplW | rplB, rplW | AE000408 |
| 77, 481 | EcXA051b | rplW | rplW | rplW | AE000408 |
| 78, 482 | EcXA052 | infC | infC | infC | AE000267 AE000266 |
| 79, 483 | EcXA053 | gor | gor | gor | AE000426 |
| 80, 484 | EcXA054 | rplF | rplF | rplF | AE000408 |
| 81, 485 | EcXA055 | rrlG | rrlG | rrlG | AE000345 |

Example 4
Identification of Genes and their Corresponding Operons Affected by Antisense Inhibition The sequencing of the entire *E. coli* genome is described in Blattner et al., Science 277:1453–1474(1997) the entirety of which is hereby incorporated by reference and the sequence of the genome is listed in GenBank Accession No.U00096, the disclosure of which is incorporated herein by reference in its entirety. The operons to which the proliferation-inhibiting nucleic acids correspond were identified using RegulonDB and information in the literature. The coordinates of the boundaries of these operons on the *E. coli* genome are listed in Table III. Table II lists the molecule numbers of the inserts containing the growth inhibiting nucleic acid fragments, the genes in the operons corresponding to the inserts, the SEQ ID NOs of the genes containing the inserts, the SEQ ID NOs of the proteins encoded by the genes, the start and stop points of the genes on the *E. coli* genome, the orientation of the genes on the genome, whether the operons are predicted or documented, and the predicted functions of the genes. The identified operons, their putative functions, and whether or not the genes are presently thought to be required for proliferation are discussed below.

Functions for the identified genes were determined by using either Blattner functional class designations or by comparing identified sequence with known sequences in various databases. A variety of biological functions were noted for the genes to which the clones of the present invention correspond. The functions for the genes of interest appear in Table II.

The proteins that are listed in Table II are involved in a wide range of biological functions.

TABLE II

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| 82 | 243 | EcXA001 | yhhQ | 3606848 | 3607513 | (P) | Hypothetical ORF, unclassified, unknown | Hypothetical outer membrane protein |
| 83 | 244 | | derB | 3607532 | 3608143 | | Hypothetical ORF, unclassified, unknown | Resistance to phage CI; periplasmic protein perhaps anchored to inner membrane |
| 84 | 245 | EcXA002 | lcpB | 2702355 | 2703329 | (P) | Transport and binding proteins | Secretion |
| 85 | 246 | EcXA003 | ycbZ | 1015762 | 1017522 | (P) | Unknown | Protease |
| 86 | 247 | EcXA004 | tufA | 3467782 | 3468966 | (D) | Translation, post-translational modification | Translation (Elongation factor Tu) |
| 87 | 248 | | fusA | 3469037 | 3471151 | | Translation, post-translational modification | Translation (elongation factor efg) |
| 88 | 249 | | rpsG | 3471179 | 3471718 | | Translation, post-translational modification | Translation |
| 89 | 402 | EcXA055 | rrsG | 2727636 | 2729178 | | Translation, post-translational modification | Translation (rRNA) |
| 90 | 250 | | rpsL | 3471815 | 3471815 | | Translation, post-translational modification | Translation |
| 91 | 251 | EcXA005a-g | rplJ | 4177574 | 4178071 | (D) | Translation, post-translational modification | Translation |
| 92 | 252 | | rplL | 4178138 | 4178503 | | Translation, post-translational modification | Translation |
| 93 | 253 | EcXA006 | pta | 2412767 | 2414911 | (P) | Carbon compound catabolism | Carbon compound catabolism |
| 94 | 254 | EcXA007 | yicP | 3841591 | 3843357 | (P) | Hypothetical ORF, unclassified, unknown | Probable adenine dearmnase |
| 95 | 255 | EcXA008a-c | yhaD | 3268266 | 3269492 | (P) | Hypothetical ORF, unclassified, unknown | |
| 96 | 256 | | yhaE | 3269508 | 3270407 | | Putative enzymes | |
| 97 | 257 | | yhaF | 3270428 | 3271198 | | Hypothetical ORF, unclassified, unknown | |
| 98 | 258 | | yhaU | 3271214 | 3272548 | | Carbon compound catabolism | Probable integral membrane protein Phthalate permease family |
| 99 | 259 | EcXA009 | ydeX | 1599514 | 1601049 | (P) | Putative transport proteins | |
| 100 | 260 | | ydeY | 1601043 | 1602071 | | Putative transport proteins | Putative ABC transporter |
| 101 | 261 | | ydeZ | 1602071 | 1603063 | | Hypothetical ORF, unclassified, unknown | |
| 102 | 262 | | yneA | 1603075 | 1604097 | | Hypothetical ORF, unclassified. unknown | |
| 103 | 263 | | yneB | 1604124 | 1604999 | | Hypothetical ORF, unclassified, unknown | |
| 104 | 264 | | yneC | 1605023 | 1605313 | | Hypothetical ORF, | |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| | | | | | | | unclassified, unknown | |
| 105 | 265 | EcXA010a-b | ftsZ | 105305 | 106456 | (P) | Cell processes (incl. Adaptation, protection) | Regulator of cell division |
| 106 | 266 | EcXA011 | fdnG | 1545425 | 1548472 | (D) | Energy metabolism | Anaerobic respiration (formate dehydrogenase) |
| 107 | 267 | | fdnH | 1548485 | 1549369 | | Energy metabolism | |
| 108 | 268 | | fdnI | 1549362 | 1550015 | | Energy metabolism | |
| | | EcXA012a-c | Same operon as EcXA004 | | | | | |
| 109 | 269 | EcXA013a-c | yhfL | 2697683 | 2697943 | (P) | Hypothetical ORF, unclassified, unknown | No homologues, no motifs |
| 110 | 270 | EcXA014 | visC | 3049135 | 3050337 | (P) | Hypothetical ORF, unclassified, unknown | Ubiquinone synthesis |
| 111 | 271 | | ubiH | 3050360 | 3051538 | | Biosynthesis of cofactors, prosthetic groups and carriers | |
| 112 | 272 | | pepP | 3051535 | 3052860 | | Translation, post-translational modification | |
| 113 | 273 | | ygfB | 3052886 | 3053470 | | Hypothetical ORF, unclassified, unknown | |
| 114 | 274 | EcXA015 | yfdG | 2465875 | 2466237 | (P) | Hypothetical ORF, unclassified, unknown | |
| 115 | 275 | | yfdH | 2466234 | 2467154 | | Cell structure | |
| 116 | 276 | | yfdI | 2467151 | 2468482 | | Hypothetical ORF, unclassified, unknown | Putative membrane protein |
| 117 | 277 | EcXA016 | yeaQ | 1877031 | 1877279 | (P) | Hypothetical ORF, unclassified, unknown | Homologue to transgly-cosylase associated protein |
| 118 | 278 | | yoaG | 1877427 | 1877609 | (P) | Hypothetical ORF, unclassified, unknown | No homologues |
| 119 | 279 | | yeaR | 1877613 | 1877972 | | Hypothetical ORF, unclassified, unknown | |
| 120 | 280 | EcXA017a-b | yggE | 3065360 | 3066100 | (P) | Structural proteins | Homologues in multiple bacteria, no motifs |
| 121 | 281 | EcXA018a-b | yegM | 2151891 | 2153285 | (P) | Putative transport proteins | Transport (multiple transferable resistance) |
| 122 | 282 | | yegN | 2153285 | 2156407 | | Hypothetical ORF, unclassified, unknown | |
| 123 | 283 | | yegO | 2156408 | 2159485 | | Hypothetical ORF, unclassified, unknown | |
| 124 | 284 | | yegB | 2159486 | 2160901 | | Putative transport proteins | |
| 125 | 285 | EcXA019a-b | yehA | 2185400 | 2186434 | (P) | Cell structure | Weak homology to pilin precursor from *H. Inf.* |
| 126 | 286 | | yehB | 2186450 | 2188930 | | Hypothetical ORF, unclassified, unknown | |
| 127 | 287 | | yehC | 2188946 | 2189665 | | Putative chaperones | |
| 128 | 288 | | yehD | 2189700 | 2190242 | | Cell structure | |
| | | EcXA020 | Same operon as EcXA016 (one of the two) | | | | | |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| 129 | 289 | EcXA021a-b | yafU | 238746 | 239084 | (P) | Hypothetical ORF, unclassified, unknown | Homologues *H. Inf.* and *S. Pombe.*, no motifs, transmembrane region present |
| 130 | 290 | EcXA022 | ydgL | 1703791 | 1704372 | (P) | Hypothetical ORF, unclassified, unknown | |
| 131 | 291 | | ydgM | 1704372 | 1704950 | | Hypothetical ORF, unclassified, unknown | |
| 132 | 292 | | ydgN | 1704943 | 1707165 | | Hypothetical ORF, unclassified, unknown | |
| 133 | 293 | | ydgO | 1707166 | 1708224 | | Hypothetical ORF, unclassified, unknown | |
| 134 | 294 | | ydgP | 1708228 | 1708848 | | Hypothetical ORF, unclassified, unknown | |
| 135 | 295 | | ydgQ | 1708852 | 1709547 | | Hypothetical ORF, unclassified, unknown | |
| 136 | 296 | | nth | 1709547 | 1710182 | | Transcription, RNA processing and degradation | |
| 137 | 297 | EcXA023a-b | ydeR | 1585817 | 1586320 | (P) | Hypothetical ORF, unclassified, unknown | |
| 138 | 298 | | ydeS | 1586333 | 1586863 | | Hypothetical ORF, unclassified, unknown | fimf-like |
| 139 | 299 | | ydeT | 1586877 | 1588025 | | Structural proteins | fimd-like |
| 140 | 300 | EcXA024 | ygjM | 3231369 | 3231785 | (P) | Hypothetical ORF, unclassified, unknown | Weak homology to long chain fatty acid coa ligase in Archaeglobus |
| 141 | 301 | | ygiN | 3231782 | 3232096 | | Hypothetical ORF, unclassified, unknown | Homologues in various bacteria |
| 142 | 302 | EcXA025 | yeeJ | 2042885 | 2050036 | (P) | Hypothetical ORF, unclassified, unknown | Strong similarity to numerous attaching amd effacing proteins and invasins |
| 143 | 303 | EcXA026 | rajA | 331001 | 331184 | unpredicted | | nifm like |
| 144 | 304 | EcXA027a-d | yohG | 2225343 | 2226539 | (P) | Putative transport proteins | |
| 145 | 305 | | yohH | 2226569 | 2226859 | | Hypothetical ORF, unclassified, unknown | Xylose binding protein-like |
| 146 | 306 | | yohI | 2227458 | 2228405 | (P) | Putative regulatory protein | |
| 147 | 307 | EcXA028 | ycfI | 2420669 | 2421559 | (P) | Hypothetical ORF, unclassified, unknown | Similar to *S. Typhi* histidine transport gene |
| 148 | 308 | EcXA029 | yjjK | 4626424 | 4628091 | (P) | Hypothetical ORF, unclassified, unknown | Similar to ABC transporter |
| 149 | 309 | EcXA030 | yi5A | 3718309 | 3718830 | (P) | Hypothetical ORF, unclassified, unknown | IS150 orf A |
| 150 | 310 | | yi5B | 3718827 | 3719678 | | Phage, transposon, or plasmid | |
| 151 | 311 | EcXA031 | rpmJ | 3440255 | 3440371 | (D) | Translation, post-tanslational modification | |
| 152 | 312 | | prlA | 3440403 | 3441734 | | Putative transport proteins | |
| 153 | 313 | | rplO | 3441742 | 3442176 | | Translation, post-translational modification | |
| 154 | 314 | | rpmD | 3442180 | 3442359 | | Translation, post- | |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| 155 | 315 | | rpsE | 3442363 | 3442866 | | Translation, post-translational modification | |
| 156 | 316 | | rplR | 3442881 | 3443234 | | Translation, post-translational modification | |
| 157 | 317 | | rplF | 3443244 | 3443777 | | Translation, post-translational modification | Translation |
| 158 | 318 | | rpsH | 3443790 | 3444182 | | Translation, post-translational modification | |
| 159 | 319 | | rpsN | 3444216 | 3444521 | | Translation, post-translational modification | |
| 160 | 320 | | rplE | 3444536 | 3445075 | | Translation, post-translational modification | Translation |
| 161 | 321 | | rplX | 3445090 | 3445404 | | Translation, post-translational modification | |
| 162 | 322 | | rplN | 3445415 | 3445786 | | Translation, post-translational modification | |
| 163 | 323 | EcXA032a-b | ybgD | 751452 | 752018 | (P) | Cell processes (incl. Adaptation, protection) | Hypothetical fimbrial protein |
| 164 | 324 | | gltA | 752408 | 753691 | (D) | Energy metabolism | Glutamine biosynthesis |
| 165 | 325 | EcXA033a-b | waaE | 3192961 | 3194394 | (P) | Putative enzymes | ADP heptose synthase/autotrophic growth protein |
| 166 | 326 | | glnE | 3194442 | 3197282 | | Translation, post-translational modification | |
| 167 | 327 | | ygiF | 3197305 | 3198606 | | Hypothetical ORF, unclassified, unknown | |
| 168 | 328 | EcXA034a-b | cspA | 3717678 | 3717890 | (P) | Cell processes (incl. Adaptation, protection) | RNA chaperonin |
| 169 | 329 | EcXA035 | yhjS | 3694087 | 3695658 | (P) | Translation, post-translational modification | |
| 170 | 330 | | yhjT | 3695658 | 3695846 | | Hypothetical ORF, unclassified, unknown | |
| 171 | 331 | | yhjU | 3695843 | 3697522 | | Hypothetical ORF, unclassified, unknown | Regions similar to dehydro-genases, nucleases etc. |
| 172 | 332 | EcXA036 | yqjC | 3246594 | 3246977 | (P) | Hypothetical ORF, unclassified, unknown | |
| 173 | 333 | | yqjD | 3247015 | 3247320 | | Hypothetical ORF, unclassified, unknown | |
| 174 | 334 | | yqjE | 3247323 | 3247727 | | Hypothetical ORF, unclassified, unknown | |
| 175 | 335 | | yqjK | 3247717 | 3248016 | | Similar to mukb from *H Inf.* | |
| 176 | 336 | | yqjF | 3248112 | 3248594 | (P) | Hypothetical ORF, unclassified, unknown | Homologues in many bacteria, blocks; secretion/ATP synthase/ftsz |
| 177 | 337 | EcXA037 | ydeH | 1620984 | 1621874 | (P) | Hypothetical ORF, unclassified, unknown | Similar to carboxy-kinase, oxidase, symporters |
| 178 | 338 | EcXA038 | sieB | 1416572 | 1417183 | (P) | Phage, transposon, or | Super-infection |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| | | | | | | | plasmid | exclusion factor B-like |
| 179 | 339 | | rajB (b1354) | 1417192 | 1417368 | | Hypothetical ORF, unclassified, unknown | |
| 180 | 340 | EcXA039 | rhsD | 522485 | 526765 | (P) | Hypothetical ORF, unclassified, unknown | |
| 181 | 341 | | ybbC | 526805 | 527173 | | Hypothetical ORF, unclassified, unknown | |
| 182 | 342 | | ylbH | 527173 | 527883 | | Hypothetical ORF, unclassified, unknown | Rhs-like element |
| 183 | 343 | | ybbD | 527864 | 528124 | | Hypothetical ORF, unclassified, unknown | ATP synthase, desaturase |
| 184 | 344 | | ylbI | 528163 | 528354 | | Hypothetical ORF, unclassified, unknown | |
| 185 | 345 | EcXA04O | insB_6 | 351114 | 351389 | (P) | Phage, transposon, or plasmid | |
| 186 | 346 | | insA | 351308 | 3581811 | | Phage, transposon, or plasmid | |
| 187 | 347 | | yrhA | 3580669 | 3581085 | | Hypothetical ORF, unclassified, unknown | |
| 188 | 348 | | yhhZ | 3579494 | 3580672 | | Hypothetical ORF, unclassified, unknown | |
| 189 | 349 | EcXA041 | ymfD | 196090 | 1196755 | (P) | Hypothetical ORF, unclassified, unknown | No assigned role |
| 190 | 350 | | ymfE | 1196756 | 1197460 | | Hypothetical ORF, unclassified, unknown | No assigned role |
| 191 | 351 | EcXA042a-b | rplY | 2280537 | 2280821 | (P) | Translation, post-translational modification | Translation |
| 192 | 352 | EcXA043 | hrsA | 765207 | 767183 | (P) | Translation, post-translational modification | |
| 193 | 353 | | ybgB | 767201 | 769834 | | Carbon compound catabolism | Unknown |
| 194 | 354 | | cydA | 770678 | 772249 | (D) | Energy metabolism | Cytochrome D oxidase |
| 195 | 355 | | cydB | 772265 | 773404 | (D) | Energy metabolism | |
| 196 | 356 | EcXA044 | purB | 1189839 | 1191209 | (D) | Nucleotide biosynthesis and metabolism | Purine biosynthesis |
| 197 | 357 | EcXA045 | csrA | 2816983 | 2817168 | (P) | Regulatory function | Carbon storage regulator (mRNA decay factor) |
| 198 | 358 | | serV | 2816575 | 2816667 | Unpredicted | Translation, post-translational modification | Translation (tRNA) |
| 199 | 359 | EcXA046 | fimB | 4538525 | 4539127 | (D) | Cell structure | |
| 200 | 360 | | fimE | 4539605 | 4540201 | | Cell structure | Fimbrae |
| 201 | 361 | | fimA | 4540683 | 4541231 | | Cell structure | Regulator of inversion |
| 202 | 362 | | fimI | 4541188 | 4541835 | | Cell structure | |
| 203 | 363 | | fimC | 4541872 | 4542597 | | Cell structure | |
| 204 | 364 | | fimD | 4542665 | 4545301 | | Cell structure | |
| 205 | 365 | | fimF | 4545311 | 4545841 | | Cell structure | |
| 206 | 366 | | fimG | 4545854 | 4546357 | | Cell structure | |
| 207 | 367 | | fimH | 4546377 | 4547279 | | Cell structure | |
| 208 | 368 | EcXA047 | ydfP | 1637054 | 1638684 | (P) | Hypothetical ORF, unclassified, unknown | |
| 209 | 369 | | ydfQ | 1637548 | 1638081 | | Hypothetical ORF, unclassified, | |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| 210 | 370 | | ydfR | 1638078 | 1638389 | | Hypothetical ORF, unclassified, unknown | |
| 211 | 371 | | ydfS | 1638394 | 1638684 | | Hypothetical ORF, unclassified, unknown | Lysis protein |
| 212 | 372 | | cspB | 1639363 | 1639578 | (P) | Cell processes (incl. Adaptation, protection) | |
| 213 | 373 | EcXA048 | yi52_7 | 2099917 | 2100933 | (P) | Phage, transposon, or plasmid | |
| 214 | 374 | | yefJ | 2100938 | 2101411 | | Putative enzymes | |
| 215 | 375 | | yefI | 2101413 | 2102531 | | Hypothetical ORF, unclassified, unknown | |
| 216 | 376 | | yefH | 2102516 | 2103106 | | Putative enzymes | |
| 217 | 377 | | yefG | 2103087 | 2104079 | | Hypothetical ORF, unclassified, unknown | |
| 218 | 378 | | rfc | 2104082 | 2105248 | | Cell structure | |
| 219 | 379 | | ycfE | 2105248 | 2106351 | | Hypothetical ORF, unclassified, unknown | UDP galacto-pyranase mutase |
| 220 | 380 | EcXA049 | yaiC | 402927 | 404042 | (P) | Hypothetical ORF, unclassified, unknown | Unknown |
| 221 | 381 | EcXA050 | yaiU | 392239 | 393642 | (P) | Putative enzymes | Putative auto-transporter |
| 222 | 382 | | yaiV | 393685 | 394353 | | Hypothetical ORF, unclassified, unknown | Hypothetical outer membrane protein |
| 223 | 383 | EcXA051a-b | rpsQ | 3445951 | 3446205 | (D) | Translation, post-translational modification | |
| 224 | 384 | | rpmC | 3446205 | 3446396 | | Translation, post-translational modification | |
| 225 | 385 | | rplP | 3446396 | 3446806 | | Translation, post-translational modification | |
| 226 | 386 | | rpsC | 3446819 | 3447520 | | Translation, post-translational modification | |
| 227 | 387 | | rplV | 3447538 | 3447870 | | Translation, post-translational modification | |
| 228 | 388 | | rpsS | 3447885 | 3448163 | | Translation, post-translational modification | |
| 229 | 389 | | rplB | 3448180 | 3449001 | | Translation, post-translational modification | Translation |
| 230 | 390 | | rplW | 3449019 | 3449321 | | Translation, post-translational modification | Translation |
| 231 | 391 | | rplD | 3449318 | 3449923 | | Translation, post-translational modification | |
| 232 | 392 | | rplC | 3449934 | 3450563 | | Translation, post-translational modification | |
| 233 | 393 | | rpsJ | 3450596 | 3450907 | | Translation, post-translational modification | |
| 234 | 394 | EcXA052 | rplT | 1797417 | 1797773 | (D) | Translation, post-translational modification | |
| 235 | 395 | | rpmI | 1797826 | 1798023 | | Translation, post-translational modification | |

TABLE II-continued

All Operon Data with Whole Chromosome Coordinates

| GeneSeq ID No. | Gene Prod. Seq ID No. | Mole. No. | Genes On Operon | Left Coordinate | Right Coordinate | Predicted (P) Or Documented (D) Operon | Blattner functional class of encoded proteins | Predicted functional class of encoded proteins |
|---|---|---|---|---|---|---|---|---|
| 236 | 396 | | infC | 1798120 | 1798662 | | Translation, post-translational modification | Translation |
| 237 | 397 | | thrS | 1798666 | 1800594 | | Translation, post-translational modification | |
| 238 | 398 | EcXA053 | gor | 3643929 | 3645281 | (P) | Biosynthesis of cofactors, prosthetic groups and carriers | Glutathione oxido-reductase |
| | | EcXA054 | Same operon as EcXA031 | | | | | |
| 239 | 399 | EcXA055 | rrlG | 2724301 | 2727204 | (D) | Translation, post-translational modification | Translation (rRNA) |
| 240 | 400 | | rrfG | 2724089 | 2724208 | | Translation, post-translational modification | Translation (rRNA) |
| 241 | 401 | | gltW | 2727389 | 2727464 | | Translation, post-translational modification | Translation (rRNA) |
| 242 | 402 | | rrsG | 2727636 | 2729178 | | Translation, post-translational modification | Translation (rRNA) |

Several of the expression vectors contain fragments that correspond to genes of unknown function or if the function is known, it is not known whether the gene is essential. For example, EcXA001, 003, 007, 008, 013, 015, 016, 017, 018, 019, 020, 021, 022, 023, 024, 025, 026, 027, 028, 029, 030, 032, 033, 034, 035, 036, 037, 038, 039, 040, 041, 047, 048, 049 and 050 are all exogenous nucleic acid sequences that correspond to *E. coli* proteins that have no known function or where the function has not been shown to be essential or nonessential.

The present invention reports a number of novel *E. coli* genes and operons that are required for proliferation. From the list clone sequences identified here, each was identified to be a portion of a gene in an operon required for the proliferation of *E. coli*. Cloned sequences corresponding to genes already known to be required for proliferation in *E. coli* include EcXA002, 004, 005, 010, 012, 014, 031, 02, 043, 045, 051 052, 054, and 055. The remaining identified sequences correspond to *E. coli* genes previously undesignated as required for proliferation in the art.

An interesting observation of the present invention is that there are also several sequence fragments that correspond to *E. coli* genes that are not thought to be required for *E. coli* proliferation. Nevertheless, under the conditions described above, the antisense expression of these gene fragments causes a reduction in cell growth. This result implies that the genes corresponding to the identified sequences are actually required for proliferation. Molecule Nos. corresponding to these genes are FcXA006, 044, 046, and 053.

Following identification of the sequences of interest, these sequences were localized into operons. Since bacterial genes are expressed in a polycistronic manner, the antisense inhibition of a single gene in an operon might effect the expression of all the other genes on the operon or the genes down stream from the single gene identified. In order to determine which of the gene products in an operon are required for proliferation, each of the genes contained within an operon may be analyzed for their effect on viability as described below.

TABLE III

Operon Boundaries

| Mole. No. | Left Coordinate | Right Coordinate |
|---|---|---|
| EcXA001 | 3606848 | 3608143 |
| EcXA002 | 2702355 | 2703329 |
| EcXA003 | 1015762 | 1017522 |
| EcXA004 | 3467782 | 3472189 |
| EcXA005 | 4177574 | 4178503 |
| EcXA006 | 2412767 | 2414911 |
| EcXA007 | 3841591 | 3843357 |
| EcXA008 | 3268266 | 3272548 |
| EcXA009 | 1599514 | 1605313 |
| EcXA010 | 1647406 | 1647458 |
| EcXA011 | 1545425 | 1550015 |
| EcXA012 | 3467782 | 3472189 |
| EcXA013 | 2697683 | 2697943 |
| EcXA014 | 3049135 | 3053470 |
| EcXA015 | 2465875 | 2468482 |
| EcXA016 | 1877031 | 1877972 |
| EcXA017 | 3065360 | 3066100 |
| EcXA018 | 2151891 | 2160901 |
| EcXA019 | 2185400 | 2190242 |
| EcXA020 | 1877031 | 1877972 |
| EcXA021 | 238746 | 239084 |
| EcXA022 | 1703791 | 1710182 |
| EcXA023 | 1585817 | 1588025 |
| EcXA024 | 3231369 | 3232096 |
| EcXA025 | 2042885 | 2050036 |
| EcXA026 | 331001 | 331184 |
| EcXA027c | 2225343 | 2228405 |
| EcXA028 | 2420669 | 2421559 |
| EcXA029 | 4626424 | 4628091 |
| EcXA030 | 3718309 | 3719678 |
| EcXA031 | 3440255 | 3445786 |
| EcXA032b | 751452 | 753691 |
| EcXA033 | 3192961 | 3198606 |

TABLE III-continued

Operon Boundaries

| Mole. No. | Left Coordinate | Right Coordinate |
|---|---|---|
| EcXA034 | 3717678 | 3717890 |
| EcXA035 | 3694087 | 3697522 |
| EcXA036 | 3246594 | 3248594 |
| EcXA037 | 1620984 | 1621874 |
| EcXA038 | 1416572 | 1417368 |
| EcXA039 | 522485 | 528354 |
| EcXA040 | 3580669 | 3580672 |
| EcXA041 | 1196090 | 1197460 |
| EcXA042 | 2280537 | 2280821 |
| EcXA043 | 765207 | 773404 |
| EcXA044 | 1189839 | 1191209 |
| EcXA045 | 2816575 | 2817168 |
| EcXA046 | 4538525 | 4547279 |
| EcXA047 | 1637054 | 1639578 |
| EcXA048 | 2099917 | 2106351 |
| EcXA049 | 402927 | 404042 |
| EcXA050 | 392239 | 394353 |
| EcXA051 | 3445951 | 3450907 |
| EcXA052 | 1797417 | 1800594 |
| EcXA053 | 3643929 | 3645281 |
| EcXA054 | 3440255 | 3445786 |
| FcXA055 | 2724301 | 2729178 |

Example 5
Identification of Individual Genes within an Operon Required for Proliferation The following example illustrates a method for determining which gene in an operon is required for proliferation. The clone insert corresponding to Molecule No. EcXA004 possesses nucleic acid sequence homology to the *E. coli* genes rspG and rspL. This molecule corresponds to an operon containing two additional genes fusA and tufA. The rpsL gene is the first gene in the operon. To determine which gene or genes in this operon are required for proliferation, each gene is selectively inactivated using homologous recombination. Gene rpsL is the first gene to be inactivated.

Deletion inactivation of a chromosomal copy of a gene in *E. coli* can be accomplished by integrative gene replacement. The principle of this method (Hamilton, C. M., et al 1989. *J. Bacteriol.* 171: 4617–4622) is to construct a mutant allele of the targeted gene, introduce that allele into the chromosome using a conditional suicide vector, and then force the removal of the native wild type allele and vector sequences. This will replace the native gene with a desired mutation(s) but leave promoters, operators, etc. intact. Essentiality of a gene is determined either by deduction from genetic analysis or by conditional expression of a wild type copy of the targeted gene (trans complementation).

The first step is to generate a mutant rpsL allele using PCR amplification. Two sets of PCR primers are chosen to produce a copy of rpsL with a large central deletion to inactivate the gene. In order to eliminate polar effects, it is desirable to construct a mutant allele comprising an in-frame deletion of most or all of the coding region of the rpsL gene. Each set of PCR primers is chosen such that a region flanking the gene to be amplified is sufficiently long to allow recombination (typically at least 500 nucleotides on each side of the deletion). The targeted deletion or mutation will be contained within this fragment. To facilitate cloning of the PCR product, the PCR primers may also contain restriction endonuclease sites found in the cloning region of a conditional knockout vector such as pKO3 (Link, et al 1997 *J. Bacteriol.* 179 (20): 6228–6237). Suitable sites include NotI, SalI, BamHI and SmaI. The rpsL gene fragments are produced using standard PCR conditions including, but not limited to, those outlined in the manufacturers directions for the Hot Start Taq PCR kit (Qiagen, Inc., Valencia, Calif.). The PCR reactions will produce two fragments that can be fused together. Alternatively, crossover PCR can be used to generate a desired deletion in one step (Ho, S. N., et al 1989. *Gene* 77: 51–59, Horton, R. M., et al 1989. *Gene* 77: 61–69). The mutant allele thus produced is called a "null" allele because it cannot produce a functional gene product.

The mutant allele obtained from PCR amplification is cloned into the multiple cloning site of pKO3. Directional cloning of the rpsL null allele is not necessary. The pKO3 vector has a temperature-sensitive origin of replication derived from pSC101. Therefore, clones are propagated at the permissive temperature of 30° C. The vector also contains two selectable marker genes: one that confers resistance to chloramphenicol and another, the *Bacillus subtilis* sacB gene, that allows for counter-selection on sucrose containing growth medium. Clones that contain vector DNA with the null allele inserted are confirmed by restriction endonuclease analysis and DNA sequence analysis of isolated plasmid DNA. The plasmid containing the rpsL null allele insert is known as a knockout plasmid.

Once the knockout plasmid has been constructed and its sequence verified, it is transformed into a Rec+ *E. coli* host cell. Transformation can be by any standard method such as electroporation. In some fraction of the transformed cells, plasmids will integrate into the *E. coli* chromosome by homologous recombination between the rpsL null allele in the plasmid and the rpsL gene in the chromosome. Transformant colonies in which such an event has occurred are readily selected by growth at the non-permissive temperature of 43° C. and in the presence of choramphenicol. At this temperature, the plasmid will not replicate as an episome and will be lost from cells as they grow and divide. These cells are no longer resistant to chloramphenicol and will not grow when it is present. However, cells in which the knockout plasmid has integrated into the *E. coli* chromosome remain resistant to chloramphenicol and propagate.

Cells containing integrated knock-out plasmids are usually the result of a single crossover event that creates a tandem repeat of the mutant and native wild type alleles of rpsL separated by the vector sequences. A consequence of this is that rpsL will still be expressed in these cells. In order to determine if the gene is essential for growth, the wild type copy must be removed. This is accomplished by selecting for plasmid excision, a process in which homologous recombination between the two alleles results in looping out of the plasmid sequences. Cells that have undergone such an excision event and have lost plasmid sequences including sacB gene are selected for by addition of sucrose to the medium. The sacB gene product converts sucrose to a toxic molecule. Thus counter selection with sucrose ensures that plasmid sequences are no longer present in the cell. Loss of plasmid sequences is further confirmed by testing for sensitivity to chloramphenicol (loss of the chloramphenicol resistance gene). The latter test is important because occasionally a mutation in the sacB gene can occur resulting in a loss of sacB function with no effect on plasmid replication (Link, et. al., 1997 *J. Bacteriol.* 179 (20): 6228–6237). These artifact clones retain plasmid sequences and are therefore still resistant to chloramphenicol.

In the process of plasmid excision, one of the two rpsL alleles is lost from the chromosome along with the plasmid DNA. In general, it is equally likely that the null allele or the wild type allele will be lost. Therefore, if the rpsL gene is not essential, half of the clones obtained in this experiment will have the wild type allele on the chromosome and half will have the null allele. However, if the rpsL gene is essential, cells containing the null allele will not be obtained as a single copy of the null allele would be lethal.

To determine the essentiality of rpsL, a statistically significant number of the resulting clones, at least 20, are analyzed by PCR amplification of the rpsL gene. Since the null allele is missing a significant portion of the rpsL gene, its PCR product is significantly shorter than that of the wild type gene and the two are readily distinguished by gel electrophoretic analysis. The PCR products may also be subjected to sequence determination for further confirmation by methods well known to those in the art.

The above experiment is generally adequate for determining the essentiality of a gene such as rpsL. However, it may be necessary or desirable to more directly confirm the essentiality of the gene. There are several methods by which this can be accomplished. In general, these involve three steps: 1) construction of an episome containing a wild type allele, 2) isolation of clones containing a single chromosomal copy of the mutant null allele as described above but in the presence of the episomal wild type allele, and then 3) determining if the cells survive when the expression of the episomal allele is shut off. In this case, the trans copy of wild type rpsL is made by PCR cloning of the entire coding region of rpsL and inserting it in the sense orientation downstream of an inducible promoter such as the *E. coli* lac promoter. Transcription of this allele of rpsL will be induced in the presence of IPTG which inactivates the lac repressor. Under IPTG induction rpsL protein will be expressed as long as the recombinant gene also possesses a ribosomal binding site, also known as a "Shine-Dalgarno Sequence". The trans copy of rpsL is cloned on a plasmid that is compatible with pSC101. Compatible vectors include p15A, pBR322, and the pUC plasmids, among others. Replication of the compatible plasmid will not be temperature-sensitive. The entire process of integrating the null allele of rpsL and subsequent plasmid excision is carried out in the presence of IPTG to ensure the expression of functional rpsL protein is maintained throughout. After the null rpsL allele is confirmed as integrated on the chromosome in place of the wild type rpsL allele, then IPTG is withdrawn and expression of functional rpsL protein shut off. If the rpsL gene is essential, cells will cease to proliferate under these conditions. However, if the rpsL gene is not essential. cells will continue to proliferate under these conditions. In this experiment, essentiality is determined by conditional expression of a wild type copy of the gene rather than inability to obtain the intended chromosomal disruption.

An advantage of this method over some other gene disruption techniques is that the targeted gene can be deleted or mutated without the introduction of large segments of foreign DNA. Therefore, polar effects on downstream genes are eliminated or minimized. There are methods described to introduce inducible promoters upstream of potential essential bacterial genes. However in such cases, polarity from multiple transcription start points can be a problem. One way of preventing this is to insert a gene disruption cassette that contains strong transcriptional terminators upstream of the integrated inducible promoter (Zhang, Y, and Cronan, J. E. 1996 *J. Bacteriol.* 178 (12): 3614–3620). The described techniques will all be familiar to one of ordinary skill in the art.

Following the analysis of the rpsL gene, the other genes of the operon are investigated to determine if they are required for proliferation.

Example 6
Expression of the Proteins Encoded by Genes Identified as Required for *E. coli* Proliferation The following is provided as one exemplary method to express the proliferation-required proteins encoded by the identified sequences described above. First, the initiation and termination codons for the gene are identified. If desired, methods for improving translation or expression of the protein are well known in the art. For example, if the nucleic acid encoding the polypeptide to be expressed lacks a methionine codon to serve as the initiation site, a strong Shine-Delgarno sequence, or a stop codon, these sequences can be added. Similarly, if the identified nucleic acid sequence lacks a transcription termination signal, this sequence can be added to the construct by, for example, splicing out such a sequence from an appropriate donor sequence. In addition, the coding sequence may be operably linked to a strong promoter or an inducible promoter if desired. The identified nucleic acid sequence or portion thereof encoding the pole peptide to be expressed is obtained by PCR from the bacterial expression vector or genome using oligonucleotide primers complementary to the identified nucleic acid sequence or portion thereof and containing restriction endonuclease sequences for NcoI incorporated into the 5' primer and Bg/II at the 5' end of the corresponding 3'-primer, taking care to ensure that the identified nucleic acid sequence is positioned in frame with the termination signal. The purified fragment obtained from the resulting PCR reaction is digested with NcoI and Bg/II, purified and ligated to an expression vector.

The ligated product is transformed into DH5α or some other *E. coil* strain suitable for the over expression of potential proteins. Transformation protocols are well known in the art. For example, transformation protocols are described in: Current Protocols in Molecular Biology, Vol. 1, Unit 1.8, (Ausubel, et al., ads.) John Wiley & Sons, Inc. (1997). Positive transformants are selected after growing the transformed cells on plates containing 50–100 μg/ml Ampicillin (Sigma, St. Louis, Mo.). In one embodiment, the expressed protein is held in the cytoplasm of the host organism. In an alternate embodiment, the expressed protein is released into the culture medium. In still another alternative, the expressed protein can be sequestered in the periplasmic space and liberated therefrom using any one of a number of cell lysis techniques known in the art. For example, the osmotic shock cell lysis method described in Chapter 16 of Current Protocols in Molecular Biology, Vol. 2. (Ausubel, et al., Eds.) John Wiley & Sons. Inc. (1997). Each of these procedures can be used to express a proliferation-required protein.

Expressed proteins, whether in the culture medium or liberated from the periplasmic space or the cytoplasm, are then purified or enriched from the supernatant using conventional techniques such as ammonium sulfate precipitation, standard chromatography, immunoprecipitation, immunochromatography, size exclusion chromatography, ion exchange chromatography, and HPLC. Alternatively, the secreted protein can be in a sufficiently enriched or pure state in the supernatant or growth media of the host to permit it to be used for its intended purpose without further enrichment. The purity of the protein product obtained can be assessed using techniques such as Coomassie or silver staining or using antibodies against the control protein. Coomassie and silver staining techniques are familiar to those skilled in the art.

Antibodies capable of specifically recognizing the protein of interest can be generated using synthetic peptides using methods well known in the art. See, Antibodies: A Laboratory Manual, (Harlow and Lane, Eds.) Cold Spring Harbor Laboratory (1988). For example, 15-mer peptides having a sequence encoded by the appropriate identified gene sequence of interest or portion thereof can be chemically synthesized. The synthetic peptides are injected into mice to generate antibodies to the polypeptide encoded by the identified nucleic acid sequence of interest or portion thereof. Alternatively, samples of the protein expressed from the expression vectors discussed above can be purified and subjected to amino acid sequencing analysis to confirm the identity of the recombinantly expressed protein and subsequently used to raise antibodies. An Example describing in detail the generation of monoclonal and polyclonal antibodies appears in Example 7.

The protein encoded by the identified nucleic acid sequence of interest or portion thereof can be purified using standard immunochromatography techniques. In such procedures, a solution containing the secreted protein, such as the culture medium or a cell extract, is applied to a column having antibodies against the secreted protein attached to the chromatography matrix. The secreted protein is allowed to bind the immunochromatography column. Thereafter, the column is washed to remove non-specifically bound proteins. The specifically bound secreted protein is then released from the column and recovered using standard techniques. These procedures are well known in the art.

In an alternative protein purification scheme, the identified nucleic acid sequence of interest or portion thereof can be incorporated into expression vectors designed for use in purification schemes employing chimeric polypeptides. In such strategies the coding sequence of the identified nucleic acid sequence of interest or portion thereof is inserted in-frame with the gene encoding the other half of the chimera. The other half of the chimera can be maltose binding protein (MBP) or a nickel binding polypeptide encoding sequence. A chromatography matrix having antibody to MBP or nickel attached thereto is then used to purify the chimeric protein. Protease cleavage sites can be engineered between the MBP gene or the nickel binding polypeptide and the identified expected gene of interest, or portion thereof. Thus, the two polypeptides of the chimera call be separated from one another by protease digestion.

One useful expression vector for generating maltose binding protein fusion proteins is pMAL (New England Biolabs), which encodes the malE gene. In the pMal protein fusion system, the cloned gene is inserted into a pMal vector downstream from the malE gene. This results in the expression of an MBP-fusion protein. The fusion protein is purified by affinity chromatography. These techniques as described are well known to those skilled in the art of molecular biology.

Example 7
Production of an Antibody to an isolated E. coli Protein

Substantially pure protein or polypeptide is isolated from the transformed cells as described in Example 6. The concentration of protein in the final preparation is adjusted, for example, by concentration on a 10,000 molecular weight cut off AMICON filter device (Millipore, Bedford, Mass.), to the level of a few micrograms/ml. Monoclonal or polyclonal antibody to the protein can then be prepared as follows:

Monoclonal Antibody Production by Hybridoma Fusion

Monoclonal antibody to epitopes of any of the peptides identified and isolated as described can be prepared from murine hybridomas according to the classical method of Kohler, G. and Milstein, C., Nature 256:495 (1975) or any of the well-known derivative methods thereof. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate here growth of the culture is continued. Antibody-producing clones are identified by detection of antibody in the supernatant fluid of the wells by immunoassay procedures, such as ELISA, as described by Engvall. E., "Enzyme immunoassay, ELISA and EMIT," Meth. Enzymol. 70:419 (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

Polyclonal Antibody Production by Immunization

Polyclonal antiserum containing antibodies to heterogeneous epitopes of a single protein or a peptide can be prepared by immunizing suitable animals wraith the expressed protein or peptides derived therefrom described above, which can be unmodified or modified to enhance immunogenicity. Effective polyclonal antibody production is affected by many factors related both to the antigen and the host species. For example, small molecules tend to be less immunogenic than larger molecules and can require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis. J. et al. J. Clin. Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: Handbook of Experimental Immunology D. Wier (ed) Blackwell (1973). Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either protocol are useful in quantitative immunoassays which determine concentrations of antigen-bearing substances in biological samples; they are also used semi-quantitatively or qualitatively to identify the presence of antigen in a biological sample. The antibodies can also be used in therapeutic compositions for killing bacterial cells expressing the protein.

Example 8
Screening Chemical Libraries
A. Protein-Based Assays

Having isolated and expressed bacterial proteins shown to be required for bacterial proliferation, the present invention further contemplates the use of these expressed proteins in assays to screen libraries of compounds for potential drug candidates. The generation of chemical libraries is well knows in the art. For example combinatorial chemistry can be used to generate a library of compounds to be screened in the assays described herein. A combinatorial chemical library is a collection of diverse chemical compounds generated by either chemical synthesis or biological synthesis by combining a number of chemical "building blocks" reagents. For example, a linear combinatorial chemical library such as a polypeptide library is formed by combining amino acids in every possible combination to yield peptides of a given length. Millions of chemical compounds theoretically can be synthesized through such combinatorial mixings of chemical building blocks. For example, one commentator observed that the systematic, combinatorial mixing of 100 interchangeable chemical building blocks results in the theoretical synthesis of 100 million tetrameric compounds or 10 billion pentameric compounds. (Gallop et al "Applications of Combinatorial Technologies to Drug Discovery, Background and Peptide Combinatorial Libraries," Journal of Medicinal Chemistry, Vol. 37, No. 9, 1233–1250 (1994). Other chemical libraries known to those in the art may also be used, including natural product libraries.

Once generated, combinatorial libraries can be screened for compounds that possess desirable biological properties. For example, compounds which may be useful as drugs or to develop drugs would likely have the ability to bind to the target protein identified, expressed and purified as discussed above. Further, if the identified target protein is an enzyme, candidate compounds would likely interfere with the enzymatic properties of the target protein. Any enzyme can be a target protein. For example, the enzymatic function of a target protein can be to serve as a protease, nuclease, phosphatase, dehydrogenase, transporter protein, transcriptional enzyme, and any other type of enzyme known or unknown. Thus, the present invention contemplates using the protein products described above to screen combinatorial chemical libraries.

Those in the art will appreciate that a number of techniques exist for characterizing target proteins in order to identify molecules useful for the discovery and development of therapeutics. For example, some techniques involve the generation and use of small peptides to probe and analyze target proteins both biochemically and genetically in order to identify and develop drug leads. Such techniques include the methods described in PCT publications No. WO9935494, WO9819162, WO9954728, the disclosures of which are incorporated herein by reference in their entireties.

In another example, the target protein is a serine protease and the substrate of the enzyme is known. The present example is directed towards the analysis of libraries of compounds to identify compounds that function as inhibitors of the target enzyme. First, a library of small molecules is generated using methods of combinatorial library formation well known in the art. U.S. Pat. Nos. 5,463,564 and 5,574,656, to Agrafiotis, et al., entitled "System and Method of Automatically Generating Chemical Compound with Desired Properties," are two such teachings. Then the library compounds are screened to identify library compounds that possess desired structural and functional properties. U.S. Pat. No. 5,684,711 also discusses a method for screening libraries.

To illustrate the screening process, the combined target and chemical compounds of the library are exposed to and permitted to interact with the purified enzyme. A labeled substrate is added to the incubation. The label on the substrate is such that a detectable signal is emitted from metabolized substrate molecules. The emission of this signal permits one to measure the effect of the combinatorial library compounds on the enzymatic activity of target enzymes. The characteristics of each library compound is encoded so that compounds demonstrating activity against the enzyme can be analyzed and features common to the various compounds identified can be isolated and combined into future iterations of libraries.

Once a library of compounds is screened, subsequent libraries are generated using those chemical building blocks that possess the features shown in the first round of screen to have activity against the target enzyme. Using this method, subsequent iterations of candidate compounds will possess more and more of those structural and functional features required to inhibit the function of the target enzyme, until a group of enzyme inhibitors with high specificity for the enzyme can be found. These compounds can then be further tested for their safety and efficacy as antibiotics for use in mammals.

It will be readily appreciated that this particular screening methodology is exemplary only. Other methods are well known to those skilled in the art. For example, a wide variety of screening techniques are known for a large number of naturally-occurring targets when the biochemical function of the target protein is known.

B. Cell Based Assays

Current cell-based assays used to identify or to characterize compounds for drug discovery and development frequently depend on detecting the ability of a test compound to inhibit the activity of a target molecule located within a cell or located on the surface of a cell. Most often such target molecules are proteins such as enzymes, receptors and the like. However, target molecules may also include other molecules such as DNAs, lipids, carbohydrates and RNAs including messenger RNAs, ribosomal RNAs, tRNAs and the like. A number of highly sensitive cell-based assay methods are available to those of skill in the art to detect binding and interaction of test compounds with specific target molecules. However, these methods are generally not highly effective when the test compound binds to or otherwise interacts with its target molecule with moderate or low affinity. In addition, the target molecule may not be readily accessible to a test compound in solution, such as when the target molecule is located inside the cell or within a cellular compartment such as the periplasm of a bacterial cell. Thus, current cell-based assay methods are limited in that they are not effective in identifying or characterizing compounds that interact with their targets with moderate to low affinity or compounds that interact with targets that are not readily accessible.

Cell-based assay methods of the present invention have substantial advantages over current cell-based assays practiced in the art. These advantages derive from the use of sensitized cells in which the level or activity of a proliferation-required gene product (the target molecule) has been specifically reduced to the point where the presence or absence of its function becomes a rate-determining step for cellular proliferation. Bacterial, fungal, plant, or animal cells can all be used with the present method. Such sensitized cells become much more sensitive to compounds that are active against the affected target molecule. Thus, cell-based assays of the present invention are capable of detecting compounds exhibiting low or moderate potency against the target molecule of interest because such compounds are substantially more potent on sensitized cells than on non-sensitized cells. The affect may be such that a test compound may be two to several times more potent, at least 10 times more potent or even at least 100 times more potent when tested on the sensitized cells as compared to the non-sensitized cells.

Due in part to the increased appearance of antibiotic resistance in pathogenic microorganisms and to the significant side-effects associated with some currently used antibiotics, novel antibiotics acting at new targets are highly sought after in the art. Yet, another limitation in the current art related to cell-based assays is the problem of identifying hits against the same kinds of target molecules in the same limited set of biological pathways over and over again. This may occur when compounds acting at such new targets are discarded, ignored or fail to be detected because compounds acting at the "old" targets are encountered more frequently and are more potent than compounds acting at the new targets. As a result, the majority of antibiotics in use currently interact with a relatively small number of target molecules within an even more limited set of biological pathways.

The use of sensitized cells of the current invention provides a solution to the above problem in two ways. First, desired compounds acting at a target of interest, whether a new target or a previously known but poorly exploited target, can now be detected above the "noise" of compounds acting at the "old" targets due to the specific and substantial increase in potency of such desired compounds when tested on the sensitized cells of the current invention. Second, the methods used to sensitize cells to compounds acting at a target of interest may also sensitize these cells to compounds acting at other target molecules within the same biological pathway. For example, expression of an antisense molecule to a gene encoding a ribosomal protein is expected to sensitize the cell to compounds acting at that ribosomal protein and may also sensitize the cells to compounds acting at any of the ribosomal components (proteins or rRNA) or even to compounds acting at any target which is part of the protein synthesis pathway. Thus an important advantage of the present invention is the ability to reveal new targets and pathways that were previously not readily accessible to drug discovery methods.

Sensitized cells of the present invention are prepared by reducing the activity or level of a target molecule. The target molecule may be a gene product, such as an RNA or polypeptide produced from the proliferation-required nucleic acids described herein. Alternatively, the target may be a gene product such as an RNA or polypeptide which is produced form a sequence within the same operon as the proliferation-required nucleic acids described herein. In addition, the target may be an RNA or polypeptide in the same biological pathway as the proliferation-required nucleic acids described herein. Such biological pathways include, but are not limited to, enzymatic, biochemical and metabolic pathways as well as pathways involved in the production of cellular structures such the cell wall.

Current methods employed in the arts of medicinal and combinatorial chemistries are able to make use of structure-activity relationship information derived from testing compounds in various biological assays including direct binding assays and cell-based assays. Occasionally compounds are directly identified in such assays that are sufficiently potent to be developed as drugs. More often, initial hit compounds exhibit moderate or low potency. Once a hit compound, is identified with low or moderate potency, directed libraries of compounds are synthesized and tested in order to identify more potent leads. Generally these directed libraries are combinatorial chemical libraries consisting of compounds with structures related to the hit compound but containing systematic variations including additions, subtractions and substitutions of various structural features. When tested for activity against the target molecule, structural features are identified that either alone or in combination with other features enhance or reduce activity. This information is used to design subsequent directed libraries containing compounds with enhanced activity against the target molecule. After one or several iterations of this process, compounds with substantially increased activity against the target molecule are identified and may be further developed as drugs. This process is facilitated by use of the sensitized cells of the present invention since compounds acting at the selected targets exhibit increased potency in such cell-based assays, thus; more compounds can now be characterized providing more useful information than would he obtained otherwise.

Thus, it is now possible using cell-based assays of the present invention to identify or characterize compounds that previously would not have been readily identified or characterized including compounds that act at targets that previously were not readily exploited using cell-based assays. The process of evolving potent drug leads from initial hit compounds is also substantially improved by the cell-based assays of the present invention because, for the same number of test compounds, more structure-function relationship information is likely to be revealed.

The method of sensitizing a cell entails selecting a suitable gene or operon. A suitable gene or operon is one whose expression is required for the proliferation of the cell to be sensitized. The next step is to introduce into the cells to be sensitized, an antisense RNA capable of hybridizing to the suitable gene or operon or to the RNA encoded by the suitable gene or operon. Introduction of the antisense RNA can be in the form of an expression vector in which antisense RNA is produced under the control of an inducible promoter. The amount of antisense RNA produced is limited by varying the inducer concentration to which the cell is exposed and thereby varying the activity of the promoter driving transcription of the antisense RNA. Thus, cells are sensitized by exposing them to an inducer concentration that results in a sub-lethal level of antisense RNA expression.

In one embodiment of the cell-based assays, the identified exogenous *E. coli* nucleotide sequences of the present invention are used to inhibit the production of a proliferation-required protein. Expression vectors producing antisense RNA against identified genes required for proliferation are used to limit the concentration of a proliferation-required protein without severly inhibiting growth. To achieve that goal, a growth inhibition dose curve of inducer is calculated by plotting various doses of inducer against the corresponding growth inhibition caused by the antisense expression. From this curve, various percentages of antisense induced growth inhibition, from 1 to 100% can be determined. If the promoter contained in the expression vector contains a lac operator the transcription is regulated by lac repressor and expression from the promoer is inducible with IPTG. For example, the highest concentration of the inducer IPTG that does not reduce the growth rate (0% growth inhibition) can be predicted from the curve. Cellular proliferation can be monitored by growth medium turbidity via OD measurements. In another example, the concentration of inducer that reduces growth by 25% can be predicted from the curve. In still another example, a concentration of inducer that reduces growth by 50% can be calculated. Additional parameters such as colony forming units (cfu) can be used to measure cellular viability.

Cells to be assayed are exposed to the above-determined concentrations of inducer. The presence of the inducer at this sub-lethal concentration reduces the amount of the proliferation required gene product to the lowest amount in the cell that will support growth. Cells grown in the presence of this concentration of inducer are therefore specifically more sensitive to inhibitors of the proliferation-required protein or RNA of interest or to inhibitors of proteins or RNAs in the same biological pathway as the proliferation-required protein or RNA of interest but not to inhibitors of unrelated proteins or RNAs.

Cells pretreated with sub-inhibitory concentrations of inducer and thus containing a reduced amount of proliferation-required target gene product are then used to screen for compounds that reduce cell growth. The sub-lethal concentration of inducer may be any concentration consistent with the intended use of the assay to identify candidate compounds to which the cells are more sensitive. For example, the sub-lethal concentration of the inducer may be such that growth inhibition is at least about 5%, at least about 8%, at least about 10%, at least about 20%, at least about 30%, at least about 40%, at least about 50%, at least about 60% at least about 75%, or more. Cells which are pre-sensitized using the preceding method are more sensitive to inhibitors of the target protein because these cells contain less target protein to inhibit than wild-type cells. In another embodiment of the cell based assays of the present invention, the level or activity of a proliferation required gene product is reduced using a temperature sensitive . . . mutation in the proliferation-required sequence and an antisense nucleic acid against the proliferation-required sequence. Growing the cells at an intermediate temperature between the permissive and restrictive temperatures of the temperature sensitive mutant where the mutation is in a proliferation-required gene produces cells with reduced activity of the proliferation-required gene product. The antisense RNA directed against the proliferation-required sequence further reduces the activity of the proliferation required gene product. Drugs that may not have been found using either the temperature sensitive mutation or the antisense nucleic acid alone may be identified by determining whether cells in which expression of the antisense nucleic acid has been induced and which are grown at a temperature between the permissive temperature and the restrictive temperature are substantially more sensitive to a test compound than cells in which expression of the antisense nucleic acid has not been induced and which are grown at a permissive temperature. Also drugs found previously from either the antisense nucleic acid alone or the temperature sensitive mutation alone may have a different sensitivity profile when used in cells combining the two approaches, and that sensitivity profile may indicate a more specific action of the drug in inhibiting one or more activities of the gene product.

Temperature sensitive mutations may be located at different sites within the gene and correspond to different domains of the protein. For example, the dnaB gene of *Escherichia coli* encodes the replication fork DNA helicase. DnaB has several domains, including domains for oligomerization, ATP hydrolysis, DNA binding, interaction with primase, interaction with DnaC, and interaction with DnaA [(Biswas, E. E. and Biswas, S. B. 1999. Mechanism and DnaB helicase of *Escherichia coli:* structural domains involved in ATP hydrolysis, DNA binding, and oligomerization. Biochem. 38:10919–10928; Hiasa, H. and Marians, K. J. 1999. Initiation of bidirectional replication at the chromosomal origin is directed by the interaction between helicase and primase. J. Biol. Chem. 274:27244–27248; San Martin, C., Radermacher. M., Wolpensinger, B., Engel. A., Miles, C. S., Dixon. N. E., and Carazo, J. M. 1998. Three-dimensional reconstructions from cryoelectron microscopy images reveal an intimate complex between helicase DnaB and its loading partner DnaC. Structure 6:501–9; Sutton, M. D., Carr, K. M., Vicente, M., and Kaguni, J. M. 1998. *Escherichia coli* DnaA protein. The N-terminal domain and loading of DnaB helicase at the *E. coli* chromosomal. J. Biol. Chem. 273:34255–62.), the disclosures of which are incorporated herein by reference in their entireties]. Temperature sensitive mutations in different domains of DnaB confer different phenotypes at the restrictive temperature, which include either an abrupt stop or slow stop in DNA replication with or without DNA breakdown (Wechsler, J. A. and Gross, J. D. 1971. *Escherichia coli* mutants temperature-sensitive for DNA synthesis. Mol. Gen. Genetics 113:273–284, the disclosure of which is incorporated herein by reference in its entirety) and termination of growth or cell death. Combining the use of temperature sensitive mutations in the dnaB gene that cause cell death at the restrictive temperature with an antisense to the dnaB gene could lead to the discovery of very specific and effective inhibitors of one or a subset of activities exhibited by DnaB.

When screening for antimicrobial agents against a gene product required for proliferation, growth inhibition of cells containing a limiting amount of that proliferation-required gene product can be assayed. Growth inhibition can be measured by directly comparing the amount of growth, measured by the optical density of the growth medium, between an experimental sample and a control sample. Alternative methods for assaying cell proliferation include measuring green fluorescent protein (GFP) reporter construct emissions, various enzymatic activity assays, and other methods well known in the art.

It will be appreciated that the above method may be performed in solid phase, liquid phase or a combination of the two. For example, cells grown on nutrient agar containing the inducer of the antisense construct may be exposed to compounds spotted onto the agar surface. A compound's effect may be judged from the diameter of the resulting killing zone, the area around the compound application point in which cells do not grow. Multiple compounds may be transferred to agar plates and simultaneously tested using automated and semi-automated equipment including but not restricted to multi-channel pipettes (for example the Beckman Multimek) and multi-channel spotters (for example the Genomic Solutions Flexys). In this way multiple plates and thousands to millions of compounds may be tested per day.

The compounds may also be tested entirely in liquid phase using microtiter plates as described below. Liquid phase screening may be performed in microtiter plates containing 96, 384, 1536 or more wells per microtiter plate to screen multiple plates and thousands to millions of compounds per day. Automated and semi-automated equipment may be used for addition of reagents (for example cells and compounds) and determination of cell density.

Example 9

The effectiveness of the above cell based assay was validated using constructs expressing antisense RNA to *E. coli* genes rplL, rplJ, and rplW encoding ribosomal proteins L7/L12, L10 and L23 respectively. These proteins are part of the protein synthesis apparatus of the cell and as such are required for proliferation. These constructs were used to test the effect of antisense expression on cell sensitivity to antibiotics known to bind to the ribosome and thereby inhibit protein synthesis. Constructs expressing antisense RNA to several other genes (elaD, visC, yohH, and aptE/B), the products of which are not involved in protein synthesis were used for comparison.

First expression vectors containing antisense constructs to either rplW or to elaD were introduced into separate *E. coli* cell populations. Vector introduction is a technique well known to those of ordinary skill in the art. The expression vectors of this example contain IPTG inducible promoters that drive the expression of the antisense RNA in the presence of the inducer. However, those skilled in the art will appreciate that other inducible promoters may also be used. Suitable expression vectors are also well known in the art. The *E. coli* antisense clones encoding ribosomal proteins L7/L12, L10 and L23 were used to test the effect of antisense expression on cell sensitivity to the antibiotics known to bind to these proteins. First, expression vectors containing antisense to either the genes encoding L7/L12 and L10 or L23 were introduced into separate *E. coli* cell populations.

The cell populations were exposed to a range of IPTG concentrations in liquid medium to obtain the growth inhibitory dose curve for each clone (FIG. 1). First, seed cultures were grown to a particular turbidity that is, measured by the optical density (OD) of the growth solution. The OD of the solution is directly related to the number of bacterial cells contained therein. Subsequently, sixteen 200 ul liquid medium cultures were grown in a 96 well microtiter plate at 37 C. with a range of IPTG concentrations in duplicate two-fold serial dilutions from 1600 uM to 12.5 uM (final concentration). Additionally, control cells were grown in duplicate without IPTG. These cultures were started from equal amounts of cells derived from the same initial seed culture of a clone of interest. The cells were grown for up to 15 hours and the extent of growth was determined by measuring the optical density of the cultures at 600 nm. When the control culture reached mid-log phase the percent growth of the control for each of the IPTG containing cultures was plotted against the log concentrations of IPTG to produce a growth inhibitory dose response curve for the IPTG. The concentration of IPTG that inhibits cell growth to 50% ($IC_{50}$) as compared to the 0 mM IPTG control (0% growth inhibition) was then calculated from the curve. Under these conditions, an amount of antisense RNA was produced that reduced the expression levels of rplW and elaD to a degree such that growth was inhibited by 50%.

Alternative methods of measuring growth are also contemplated. Examples of these methods include measurements of proteins, the expression of which is engineered into the cells being tested and can readily be measured. Examples of such proteins include green fluorescent protein (GFP) and various enzymes.

Figure 2A:
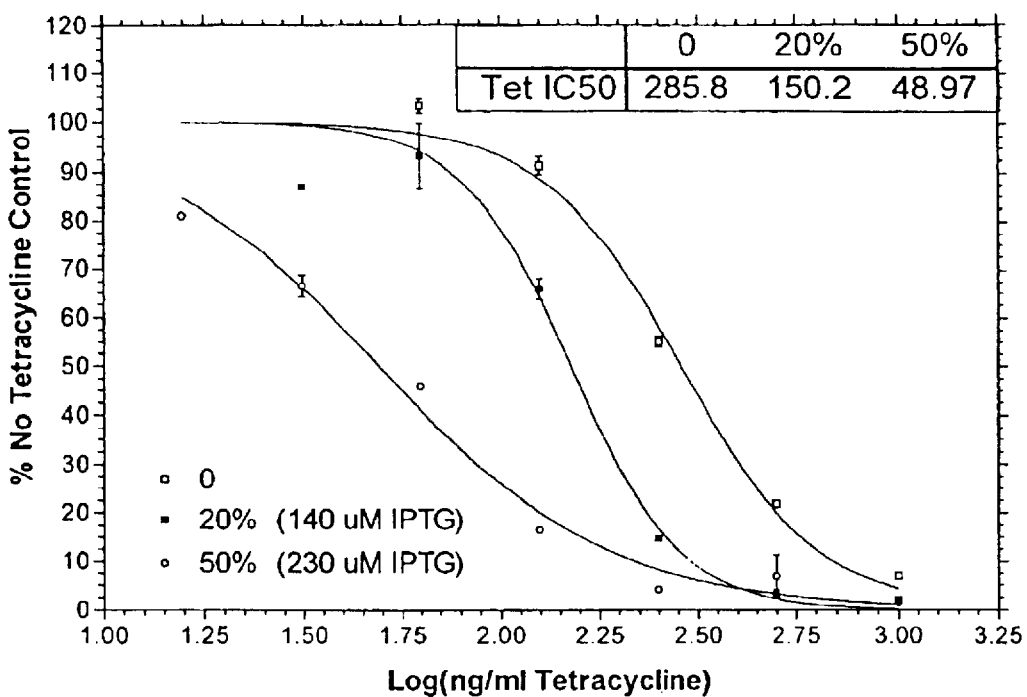
FIG. 2a is a tetracycline dose response curve in E. coli transformed with an IPTG-inducible plasmid containing antisense to rplW(AS-rplW) in the presence of 0, 20 or 50 μM IPTG.
Figure 2B:
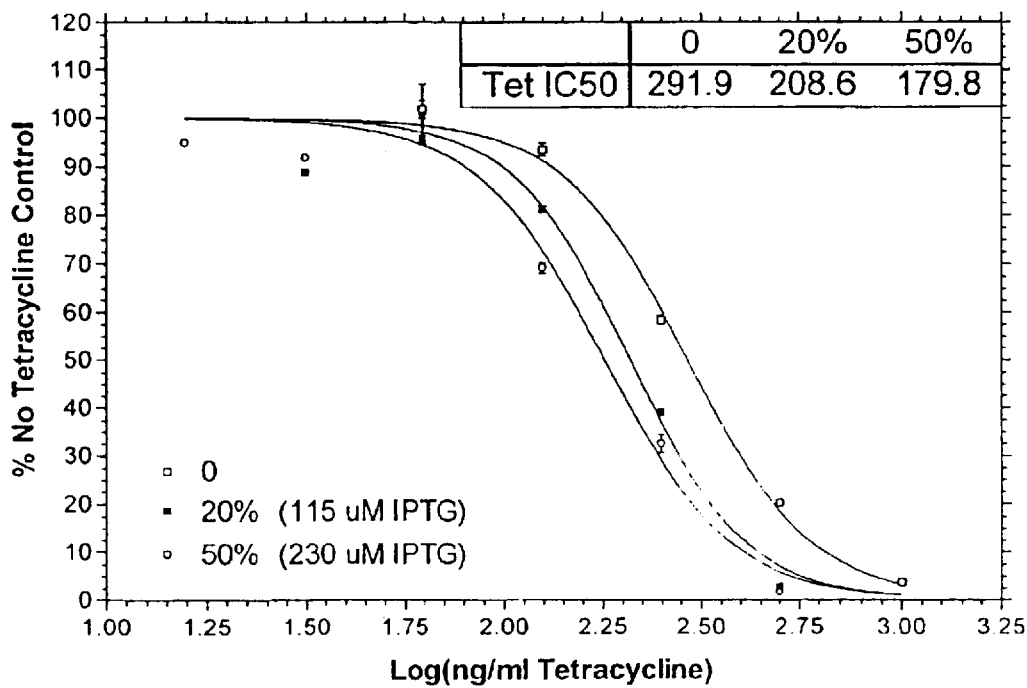
FIG. 2b is a tetracycline dose response curve in E. coli transformed with an IPTG-inducible plasmid containing antisense to elaD (AS-elaD) in the presence of 0, 20 or 50 μM IPTG.
Figure 3:
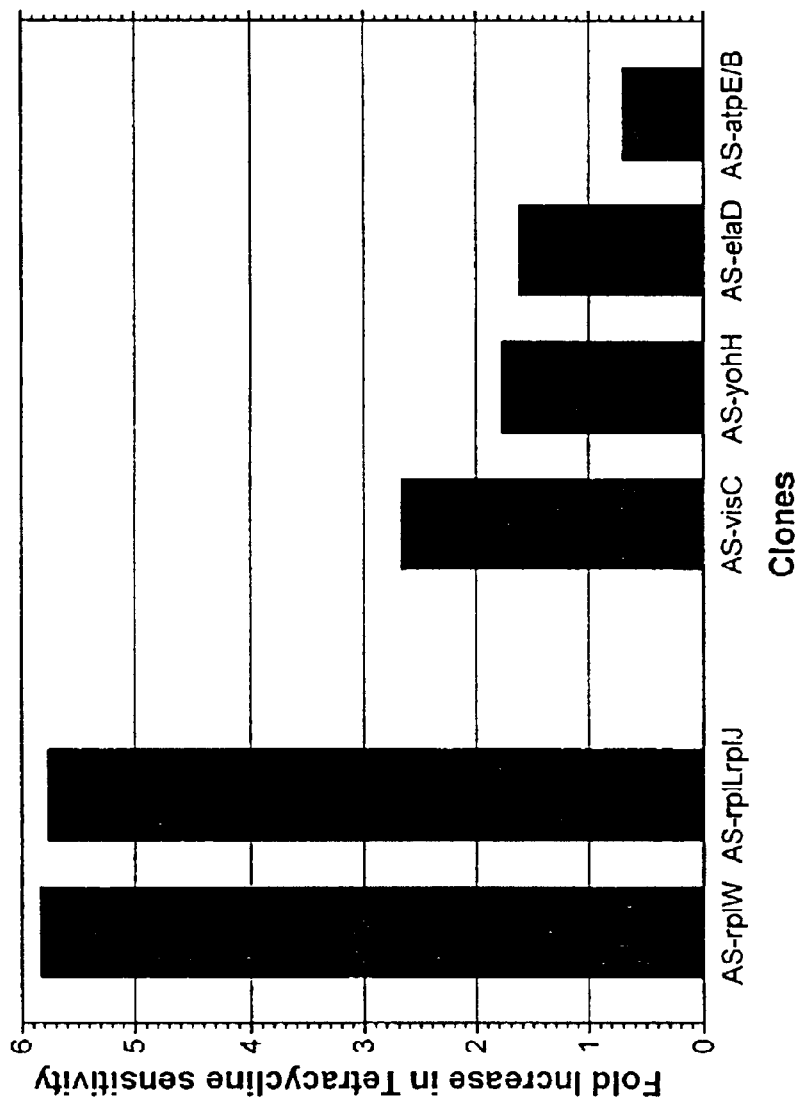
FIG. 3 is a graph showing the fold increase in tetracycline sensitivity of E. coli transfected with antisense clones to essential ribosomal proteins L23 (AS-rplW) and L7/L12 and L10 (AS-rplLrplJ). Antisense clones to genes known not to be involved in protein synthesis (atpB/E(AS-atpB/E), visC (AS-visC, elaD (AS-elaD). yohH (AS-yohH) are much less sensitive to tetracycline.

Cells were pretreated with the selected concentration of IPTG and then used to test the sensitivity of cell populations to tetracycline, erythromycin and other protein synthesis inhibitors. An example of a tetracycline dose response curve is shown in FIGS. 2A and 2B for the rplW and elaD genes, respectively. Cells were grown to log phase and then diluted into media alone or media containing IPTG at concentrations which give 20% and 50% growth inhibition as determined by IPTG dose response curves. After 2.5 hours, the cells were diluted to a final OD600 of 0.002 into 96 well plates containing (1) +/−IPTG at the same concentrations used for the 2.5 hour pre-incubation; and (2) serial two-fold dilutions of tetracycline such that the final concentrations of tetracycline range from 1 μg/ml to 15.6 ng/ml and 0 μg/ml. The 96 well plates were incubated at 37° C. and the OD600 was read by a plate reader every 5 minutes for up to 15 hours. For each IPTG concentration and the no IPTG control, tetracycline dose response curves were determined when the control (absence of tetracycline) reached 0.1 OD600. To compare tetracycline sensitivity with and without IPTG, tetracycline IC50s were determined from the dose response curves (FIGS. 2*a*–2*b*) Cells with reduced levels of L23 (rplW) showed increased sensitivity to tetracycline (FIG. 2*a*) as compared to cells with reduced levels of elaD (FIG. 2*b*). FIG. 3 shows a summary bar chart in which the ratios of tetracycline IC50s determined in the presence of IPTG which gives 50% growth inhibition versus tetracycline IC50s determined without IPTG (fold increase in tetracycline sensitivity) were plotted. Cells with reduced levels of either L7/L12 (genes rplL, rplJ) or L23 (rplW) showed increased sensitivity to tetracycline (FIG. 3). Cells expressing antisense to genes not known to be involved in protein synthesis (atpB/E, visC, elaD, yohH) did not show the same increased sensitivity to tetracycline, validating the specificity of this assay (FIG. 3).

In addition to the above; it has been observed in initial experiments that clones expressing antisense RNA to genes involved in protein synthesis (including genes encoding ribosomal proteins L7/L12 & L10, L7/L12 alone, L22, and L18, as well as genes encoding rRNA and Elongation Factor G) have increased sensitivity to the macrolide, erythromycin, whereas clones expressing antisense to the non-protein synthesis genes elaD, atpB/E and visC do not. Furthermore, the clone expressing antisense to rplL and rplJ does not show increased sensitivity to nalidixic acid and ofloxacin, antibiotics which do not inhibit protein synthesis.

The results with the ribosomal protein genes rplL, rplJ, and rplW as well as the initial results using various other antisense clones and antibiotics show that limiting the concentration of an antibiotic target makes cells more sensitive to the antimicrobial agents that specifically interact with that protein. The results also show that these cells are sensitized to antimicrobial agents that inhibit the overall function in which the protein target is involved but are not sensitized to antimicrobial agents that inhibit other functions.

The cell based assay described above may also be used to identify the biological pathway in which a proliferation-required nucleic acid or its gene product lies. In such methods, cells expressing a sub-lethal level of antisense to a target proliferation-required nucleic acid and control cells in which expression of the antisense has not been induced are contacted with a panel of antibiotics known to act in various pathways. If the antibiotic acts in the pathway in which the target proliferation-required nucleic acid or its gene product lies, cells in which expression of the antisense has been induced will be more sensitive to the antibiotic than cells in which expression of the antisense has not been induced.

As a control, the results of the assay may be confirmed by contacting a panel of cells expressing antisense nucleic acids to many different proliferation-required genes including the target proliferation-required gene. If the antibiotic is acting specifically, heightened sensitivity to the antibiotic will be observed only in the cells expressing antisense to a target proliferation-required gene (or cells expressing antisense to other proliferation-required genes in the same pathway as the target proliferation-required gene) but will not be observed generally in all cells expressing antisense to proliferation-required genes.

Similarly, the above method may be used to determine the pathway on which a test antibiotic acts. A panel of cells, each of which expresses antisense to a proliferation-required nucleic acid in a known pathway, is contacted with a compound for which it is desired to determine the pathway on which it acts. The sensitivity of the panel of cells to the test compound is determined in cells in which expression of the antisense has been induced and in control cells in which expression of the antisense has not been induced. If the test antibiotic acts on the pathway on which an antisense nucleic acid acts, cells in which expression of the antisense has been induced will be more sensitive to the antibiotic than cells in which expression of the antisense has not been induced. In addition, control cells in which expression of antisense to proliferation-required genes in other pathways has been induced will not exhibit heightened sensitivity to the antibiotic. In this way, the pathway on which the test antibiotic acts may be determined.

The Example below provides one method for performing such assays.

Example 10
Identification of the Pathway in which a Proliferation-Required Gene Lies or the Pathway on which an Antibiotic Acts A. Preparation of Bacterial Stocks for Assay To provide a consistent source of cells to screen, frozen stocks of host bacteria containing the desired antisense construct are prepared using standard microbiological techniques. For example, a single clone of the organism can be isolated by streaking out a sample of the original stock onto an agar plate containing nutrients for cell growth and an antibiotic for which the antisense construct contains a gene which confers resistance. After overnight growth an isolated colony is picked from the plate with a sterile needle and transferred to an appropriate liquid growth media containing the antibiotic required for maintenance of the plasmid. The cells are incubated at 30° C. to 37° C. with vigorous shaking for 4 to 6 hours to yield a culture in exponential growth. Sterile glycerol is added to 15% (volume to volume) and 100 $\mu$L to 500 $\mu$L aliquots are distributed into sterile cryotubes, snap frozen in liquid nitrogen, and stored at −80° C. for future assays.

B. Growth of Bacteria for Use in the Assay

A day prior to an assay, a stock vial is removed from the freezer, rapidly thawed (37° C. water bath) and a loop of culture is streaked out on an agar plate containing nutrients for cell growth and an antibiotic to which the antisense construct confers resistance. After overnight growth at 37° C., ten randomly chosen, isolated colonies are transferred from the plate (sterile inoculum loop) to a sterile tube containing 5 mL of LB medium containing the antibiotic to which the antisense vector confers resistance. After vigorous mixing to form a homogeneous cell suspension, the optical density of the suspension is measured at 600 nm (OD600) and if necessary an aliquot of the suspension is diluted into a second tube of 5 mL, sterile, LB medium plus antibiotic to achieve an OD600≦0.02 absorbance units. The culture is then incubated at 37° C. for 1–2 hrs with shaking until the OD600 reaches OD 0.2–0.3. At this point the cells are ready to be used in the assay.

C. Selection of Media to be Used in Assay

Two fold dilution series of the inducer are generated in culture media containing the appropriate antibiotic for maintenance of the antisense construct. Several media are tested side by side and three to four wells are used to evaluate the effects of the inducer at each concentration in each media. For example, M9 minimal media, LB broth, TBD broth and Muller-Hinton media may be tested with the inducer IPTG at the following concentrations, 50 $\mu$M, 100 $\mu$M, 200 $\mu$M, 400 $\mu$M, 600 $\mu$M, 800 $\mu$M and 1000 $\mu$M. Equal volumes of test media-inducer and cells are added to the wells of a 384 well microtiter plate and mixed. The cells are prepared as described above and diluted 1:100 in the appropriate media containing the test antibiotic immediately prior to addition to the microtiter plate wells. For a control, cells are also added to several wells of each media that do not contain inducer, for example 0 $\mu$M IPTG. Cell growth is monitored continuously by incubation at 37° C. in a microtiter plate reader monitoring the OD600 of the wells over an 18-hour period. The percent inhibition of growth produced by each concentration of inducer is calculated by comparing the rates of logarithmic growth against that exhibited by cells growing in media without inducer. The medium yielding greatest sensitivity to inducer is selected for use in the assays described below.

D. Measurement of Test Antibiotic Sensitivity in the Absence of Antisense Construct Induction Two-fold dilution series of antibiotics of known mechanism of action are generated in the culture media selected for further assay development that has been supplemented with the antibiotic used to maintain the construct. A panel of test antibiotics known to act on different pathways is tested side by side with three to four wells being used to evaluate the effect of a test antibiotic on cell growth at each concentration. Equal volumes of test antibiotic and cells are added to the wells of a 384 well microtiter plate and mixed. Cells are prepared as described above using the media selected for assay development supplemented with the antibiotic required to maintain the antisense construct and are diluted 1:100 in identical media immediately prior to addition to the microtiter plate wells. For a control, cells are also added to several wells that contain the solvent used to dissolve the antibiotics but no antibiotic. Cell growth is monitored continuously by incubation at 37° C. in a microtiter plate reader monitoring the OD600 of the wells over an 18-hour period. The percent inhibition of growth produced by each concentration of antibiotic is calculated by comparing the rates of logarithmic growth against that exhibited by cells growing in media without antibiotic. A plot of percent inhibition against log[antibiotic concentration] allows extrapolation of an $IC_{50}$ value for each antibiotic.

E. Measurement of Test Antibiotic Sensitivity in the Presence of Antisense Construct Inducer The culture media selected for use in the assay is supplemented with inducer at concentrations shown to inhibit cell growth by 50 and 80% as described above and the antibiotic used to maintain the construct. Two fold dilution series of the panel of test antibiotics used above are generated in each of these media. Several antibiotics are tested side by side with three to four wells being used to evaluate the effects of an antibiotic on cell growth at each concentration, in each media. Equal volumes of test antibiotic and cells are added to the wells of a 384 well microtiter plate and mixed. Cells are prepared as described above using the media selected for use in the assay supplemented with the antibiotic required to maintain the antisense construct. The cells are diluted 1:100 into two 50 mL aliquots of identical media containing concentrations of inducer that have been shown to inhibit cell growth by 50% and 80% respectively and incubated at 37° C. with shaking for 2.5 hours. Immediately prior to addition to the microtiter plate wells, the cultures are adjusted to an appropriate $OD_{600}$ (typically 0.002) by dilution into warm (37° C.) sterile media supplemented with identical concentrations of the inducer and antibiotic used to maintain the antisense construct. For a control, cells are also added to several wells that contain solvent used to dissolve test antibiotics but which contain no antibiotic. Cell growth is monitored continuously by incubation at 37° C. in a microtiter plate reader monitoring the OD600 of the wells over an 18-hour period. The percent inhibition of growth produced by each concentration of antibiotic is calculated by comparing the rates of logarithmic growth against that exhibited by cells growing in media without antibiotic. A plot of percent inhibition against log[antibiotic concentration] allows extrapolation of an $IC_{50}$ value for each antibiotic.

F. Determining the Specificity of the Test Antibiotics

A comparison of the $IC_{50}$s generated by antibiotics of known mechanism of action under antisense induced and non-induced conditions allows the pathway in which a proliferation-required nucleic acid lies to be identified. If cells expressing an antisense nucleic acid against a proliferation-required gene are selectively sensitive to an antibiotic acting via a particular pathway, then the gene against which the antisense acts is involved in the pathway in which the antibiotic acts.

G. Identification of Pathway in which a Test Antibiotic Acts

As discussed above, the cell based assay may also be used to determine the pathway against which a test antibiotic acts. In such an analysis, the pathways against which each member of a panel of antisense nucleic acids acts are identified as described above. A panel of cells, each containing an inducible antisense vector against a gene in a known proliferation-required pathway, is contacted with a test antibiotic for which it is desired to determine the pathway on which it acts under inducing an non-inducing conditions. If heightened sensitivity is observed in induced cells expressing antisense against a gene in a particular pathway but not in induced cells expressing antisense against genes in other pathways, then the test antibiotic acts against the pathway for which heightened sensitivity was observed.

One skilled in the art will appreciate that further optimization of the assay conditions, such as the concentration of inducer used to induce antisense expression and/or the growth conditions used for the assay (for example incubation temperature and media components) may further increase the selectivity and/or magnitude of the antibiotic sensitization exhibited.

The following example confirms the effectiveness of the methods described above.

Example 11
Identification of the Pathway in which a Proliferation-Required Gene Lies Antibiotics of various chemical classes and modes of action were purchased from Sigma Chemicals (St. Louis, Mo.). Stock solutions were prepared by dissolving each antibiotic in an appropriate aqueous solution based on information provided by the manufacturer. The final working solution of each antibiotic contained no more than 0.2% (w/v) of any organic solvent. To determine their potency against a bacterial strain engineered for expression of an antisense against a proliferation-required 50S ribosomal protein, each antibiotic was serially diluted two or three fold in growth medium supplemented with the appropriate antibiotic for maintenance of the anti-sense construct. At least ten dilutions were prepared for each antibiotic. 25 μL aliquots of each dilution were transferred to discrete wells of a 384-well microplate (the assay plate) using a multi-channel pipette. Quadruplicate wells were used for each dilution of an antibiotic under each treatment condition (plus and minus inducer). Each assay plate contained twenty wells for cell growth controls (growth media replacing antibiotic), ten wells for each treatment (plus and minus inducer, in this example IPTG). Assay plates were usually divided into the two treatments: half the plate containing induced cells and an appropriate concentrations of inducer (in this example IPTG) to maintain the state of induction, the other half containing non-induced cells in the absence of IPTG.

Cells for the assay were prepared as follows. Bacterial cells containing a construct, from which expression of antisense nucleic acid against rplL and rplJ, which encode proliferation-required 50S ribosomal subunit proteins, is inducible in the presence of IPTG, were grown into exponential growth ($OD_{600}$ 0.2 to 0.3) and then diluted 1:100 into fresh media containing either 400 μM or 0 μM inducer (IPTG). These cultures were incubated at 37° C. for 2.5 hr. After a 2.5 hr incubation, induced and non-induced cells were respectively diluted into an assay medium at a final $OD_{600}$ value of 0.0004. The medium contained an appropriate concentration of the antibiotic for the maintenance of the anti-sense construct. In addition, the medium used to dilute induced cells was supplemented with 800 μM IPTG so that addition to the assay plate would result in a final IPTG concentration of 400 μM. Induced and non-induced cell suspensions were dispensed (25 μl/well) into the appropriate wells of the assay plate as discussed previously. The plate was then loaded into a plate reader, incubated at constant temperature, and cell growth was monitored in each well by the measurement of light scattering at 595 nm. Growth was monitored every 5 minutes until the cell culture attained a stationary growth phase. For each concentration of antibiotic, a percentage inhibition of growth was calculated at the time point corresponding to mid-exponential growth for the associated control wells (no antibiotic, plus or minus IPTG). For each antibiotic and condition (plus or minus IPTG), a plot of percent inhibition versus log of antibiotic concentration was generated and the IC50 determined. A comparison of the $IC_{50}$ for each antibiotic in the presence and absence of IPTG revealed whether induction of the antisense construct sensitized the cell to the mechanism of action exhibited by the antibiotic. Cells which exhibited a significant (standard statistical analysis) numerical decrease in the $IC_{50}$ value in the presence of inducer were considered to have an increased sensitivity to the test antibiotic.

The results are provided in the table below, which lists the classes and names of the antibiotics used in the analysis, the targets of the antibiotics, the IC50 in the absence of IPTG, the IC50 in the presence of IPTG, the concentration units for the IC50s, the fold increase in IC50 in the presence of IPTG, and whether increased sensitivity was observed in the presence of IPTG.

TABLE IV

Effect of Expression of Antisense RNA to rplL and rplJ on Antibiotic Sensitivity

| ANTIBIOTIC CLASS/Names | TARGET | IC50 (−IPTG) | IC50 (+IPTG) | Conc. Unit | Fold Increase in Sensitivity | Sensitivity Increased? |
|---|---|---|---|---|---|---|
| PROTEIN SYNTHESIS INHIBITOR ANTIBIOTICS |  |  |  |  |  |  |
| AMINOGLYCOSIDES |  |  |  |  |  |  |
| Gentamicin | 30S ribosome function | 2715 | 19.19 | ng/ml | 141 | Yes |
| Streptomycin | 30S ribosome function | 11280 | 161 | ng/ml | 70 | Yes |
| Spectinomycin | 30S ribosome function | 18050 | <156 | ng/ml |  | Yes |
| Tobramycin | 30S ribosome function | 3594 | 70.58 | ng/ml | 51 | Yes |
| MACROLIDES |  |  |  |  |  |  |
| Erythromycin | 50S ribosome function | 7467 | 187 | ng/ml | 40 | Yes |
| AROMATIC POYKETIDES |  |  |  |  |  |  |
| Tetracycline | 30S ribosome function | 199.7 | 1.83 | ng/ml | 109 | Yes |
| Minocycline | 30S ribosome function | 668.4 | 3.397 | ng/ml | 172 | Yes |
| Doxycycline | 30S ribosome function | 413.1 | 27.81 | ng/ml | 15 | Yes |
| OTHER PROTEIN SYNTHESIS INHIBITORS |  |  |  |  |  |  |
| Fusidic acid | Elongation Factor G function | 59990 | 641 | ng/ml | 94 | Yes |
| Chloramphenicol | 30S ribosome function | 465.4 | 1.516 | ng/ml | 307 | Yes |
| Lincomycin | 50S ribosome function | 47150 | 324.2 | ng/ml | 145 | Yes |
| OTHER ANTIBIOTIC MECHANISMS |  |  |  |  |  |  |
| B-LACTAMS |  |  |  |  |  |  |
| Cefoxitin | Cell wall biosynthesis | 2782 | 2484 | ng/ml | 1 | No |
| Cefotaxime | Cell wall biosynthesis | 24.3 | 24.16 | ng/ml | 1 | No |
| DNA SYNTHESIS INHIBITORS |  |  |  |  |  |  |
| Nalidixic acid | DNA Gyrase activity | 6973 | 6025 | ng/ml | 1 | No |
| Ofloxacin | DNA Gyrase activity | 49.61 | 45.89 | ng/ml | 1 | No |
| OTHER |  |  |  |  |  |  |
| Bacitracin | Cell membrane function | 4077 | 4677 | mg/ml | 1 | No |
| Trimethoprim | Dihydrofolate Reductase activity | 128.9 | 181.97 | ng/ml | 1 | No |
| Vancomycin | Cell wall biosynthesis | 145400 | 72550 | ng/ml | 2 | No |

The above results demonstrate that induction of an antisense RNA to genes encoding 50S ribosomal subunit proteins results in a selective and highly significant sensitization of cells to antibiotics that inhibit ribosomal function and protein synthesis. The above results further demonstrate that induction of an antisense construct to an essential gene sensitizes an organism to compounds that interfere with that gene products' biological role. This sensitization is restricted to compounds that interfere with pathways associated with the targeted gene and it's product.

Assays utilizing antisense constructs to essential genes can be used to identify compounds that specifically interfere with the activity of multiple targets in a pathway. Such constructs can be used to simultaneously screen a sample against multiple targets in one pathway in one reaction (Combinatorial HTS).

Furthermore, as discussed above, panels of antisense construct containing cells may be used to characterize the point of intervention of any compound affecting an essential biological pathway including antibiotics with no known mechanism of action.

Another embodiment of the present invention is a method for determining the pathway against which a test antibiotic compound is active in which the activity of target proteins or nucleic acids involved in proliferation-required pathways is reduced by contacting cells with a sublethal concentration of a known antibiotic which acts against the target protein or nucleic acid. In one embodiment, the target protein or nucleic acid is a target protein or nucleic acid corresponding to a proliferation-required nucleic acid identified using the methods described above. The method is similar to those described above for determining which pathway a test antibiotic acts against except that rather than reducing the activity or level of a proliferation-required gene product using a sublethal level of antisense to a proliferation-required nucleic acid, the activity or level of the proliferation-required gene product is reduced using sublethal level of a known antibiotic which acts against the proliferation required gene product.

Interactions between drugs which affect the same biological pathway has been described in the literature. For example, Mecillinam (Amdinocillin) binds to and inactivates the penicillin binding protein 2 (PBP2, product of the mrdA in *E. coli*). This antibiotic inteacts with other antibiotics that inhibit PBP2 as well as antibiotics that inhibit other penicillin binding proteins such as PBP3 [(Gutmann, L., Vincent, S., Billot-Klein, D., Acar, J. F., Mrena, E., and Williamson, R. (1986) Involvement of penicillin-binding protein 2 with other penicillin-binding proteins in lysis of *Escherichia coli* by some beta-lactam antibiotics alone and in synergistic lytic effect of amdinocillin (mecillinam). Antimicrobial Agents & Chemotherapy, 30:906–912), the disclosure of which is incorporated herein by reference in its entirety]. Interactions between drugs could, therefore, involve two drugs that inhibit the same target protein or nucleic acid or inhibit different proteins or nucleic acids in the same pathway [(Fukuoka, T., Domon, H., Kakuta, M., Ishii, C., Hirasawa, A., Utsui, Y., Ohya, S., and Yasuda, H. (1997) Combination effect between panipenem and vancomycin on highly methicillin-resistant *Staphylococcus*

*aureus*. Japan. J. Antibio. 50:411–419; Smith. C. E., Foleno, B. F., Barrett, J. F., and Frosc, M. B. (1997) Assessment of the synergistic interactions of levofloxacin and ampicillin against *Enterococcus faecium* by the checkerboard agar dilution and time-kill methods. Diagnos. Microbiol. Infect. Disease 27:85–92; den Hollander, J. G., Horrevorts, A. M., van Goor, M. L., Verbrugh, H. A., and Mouton, J. W. (1 997) Synergism between tobramycin and ceftazidime against a resistant *Pseudomonas acruginosa* strain, tested in an in vitro pharmacokinetic model. Antimicrobial Agents & Chemotherapy, 41:95–110), the disclosure of all of which are incorporated herein by reference in their entireties].

Two drugs may interact even though they inhibit different targets. For example, the proton pump inhibitor. Omeprazole, and the antibiotic, Amoxycillin, two synergistic compounds acting together, can cure *Helicobacter pylori* infection [(Gabryelewicz, A., Laszewicz, W., Dzieniszewski, J., Ciok, J., Marlicz, K., Bielecki, D., Popiela. T., Legutko, J., Knapik, Z., Poniewierka, E. (1997) Multicenter evaluation of dual-therapy (omeprazol and amoxycillin) for *Helicobacter pylori*-associated duodenal and gastric ulcer (two years of the observation). J. Physiol. Pharmacol. 48 Suppl 4:93–105), the disclosure of which is incorporated herein by reference in its entirety].

The growth inhibition from the sublethal concentration of the known antibiotic may be al least about 5%, at least about 8%, at least about 10%, at least about 20%, at least about 30%, at least about 40%, at least about 50%, at least about 60%, or at least about 75%, or more.

Alternatively, the sublethal concentration of the known antibiotic may be determined by measuring the activity of the target proliferation-required gene product rather than by measuring growth inhibition.

Cells are contacted with a combination of each member of a panel of known antibiotics at a sublethal level and varying concentrations of the test antibiotic. As a control, the cells are contacted with varying concentrations of the test antibiotic alone. The $IC_{50}$ of the test antibiotic in the presence and absence of the known antibiotic is determined. If the IC50s in the presence and absence of the known drug are substantially similar, then the test drug and the known drug act on different pathways. If the $IC_{50}$s are substantially different, then the test drug and the known drug act on the same pathway.

Another embodiment of the present invention is a method for identifying a candidate compound for use as an antibiotic in which the activity of target proteins or nucleic acids involved in proliferation-required pathways is reduced by contacting cells with a sublethal concentration of a known antibiotic which acts against the target protein or nucleic acid. In one embodiment, the target protein or nucleic acid is a target protein or nucleic acid corresponding to a proliferation-required nucleic acid identified using the methods described above. The method is similar to those described above for identifying candidate compounds for use as antibiotics except that rather than reducing the activity or level of a proliferation-required gene product using a sublethal level of antisense to a proliferation-required nucleic acid, the activity or level of the proliferation-required gene product is reduced using a sublethal level of a known antibiotic which acts against the proliferation required gene product.

The growth inhibition from the sublethal concentration of the known antibiotic may be at least about 5%, at least about 8%, at least about 10%, at least about 20%, at least about 30%, at least about 40%, at least about 50%, at least about 60%, or at least about 75%, or more.

Alternatively, the sublethal concentration of the known antibiotic may be determined by measuring the activity of the target proliferation-required gene product rather than by measuring growth inhibition.

In order to characterize test compounds of interest, cells are contacted with a panel of known antibiotics at a sublethal level and one or more concentrations of the test compound. As a control, the cells are contacted with the same concentrations of the test compound alone. The $IC_{50}$ of the test compound in the presence and absence of the known antibiotic is determined. If the $IC_{50}$ of the test compound is substantially different in the presence and absence of the known drug then the test compound is a good candidate for use as an antibiotic. As discussed above, once a candidate compound is identified using the above methods its structure may be optimized using standard techniques such as combinatorial chemists.

Representative known antibiotics which may be used in each of the above methods are provided in the table below. However, it will be appreciated that other antibiotics may also be used.

| ANTIBIOTIC | INHIBITS/TARGET | RESISTANT MUTANTS |
|---|---|---|
| Inhibitors of Transcription | | |
| Rifamycin, 1959 Rifampicin Rifabutin Rifaximin | Inhibits initiation of transcription/β-subunit RNA polymerase, rpoB | rpoB, crp, cyaA |
| Streptolydigin | Accelerates transcription chain termination/β-subunit RNA polymerase | rpoB |
| Streptovaricin | an acyclic ansamycin, inhibits RNA polymerase | rpoB |
| Actinomycin D + EDTA | Intercalates between 2 successive G-C pairs, rpoB, inhibits RNA synthesis | pldA |
| Inhibitors of Nucleic Acid Metabolism | | |
| Quinolones, 1962 Nalidixic acid Oxolinic acid | α subunit gyrase and/or topoisomerase IV, gyrA | gyrAorB, icd, sloB |
| Fluoroquinolones Ciprofloxacin, 1983 Norfloxacin | α subunit gyrase, gyrA and/or topoisomerase IV (probable target in Staph) | gyrA norA (efflux in Staph) hipQ |
| Coumerins Novobiocin | Inhibits ATPase aciivity of β-subunit gyrase, gyrB | gyrB, cysB, cysE, nov, opmA |

-continued

| ANTIBIOTIC | INHIBITS/TARGET | RESISTANT MUTANTS |
|---|---|---|
| Coumermycin | Inhibits ATPase activity of β-subunit gyrase, gyrB | gyrB, hisW |
| Albicidin | DNA synthesis | tsx (nucleoside channel) |
| Metronidazole | Causes single-strand breaks in DNA | nar |
| Inhibitors of Metabolic Pathways | | |
| Sulfonamides, 1932 | blocks synthesis of dihydrofolate, dihydro | folP, gpt, pabA, pabB, |
| Sulfanilamide | pteroate synthesis, folP | pubC |
| Trimethoprim, 1962 | Inhibits dihydrofolate reductase, folA | folA, thyA |
| Showdomycin | Nucleoside analogue capable of alkylating sulfhydrl groups, inhibitor of thymidylate synthetase | nupC, pnp |
| Thiolactomycin | type II fatty acid synthase inhibitor | emrB |
| | | fadB, emrB due to gene dosage |
| Psicofuranine | Adenosine glycoside antibiotic, target is GMP synthetase | guaA,B |
| Triclosan | Inhibits fatty acid synthesis | fabl (envM) |
| Diazoborines [soniazid, | heterocyclic, contains boron, inhibit fatty | fabl (envM) |
| Ethionamide | acid synthesis, enoyl-ACP reductase, fabf | |
| Inhibitors of Translation | | |
| Phenylpropanoids | Binds to ribosomal peptidyl transfer center | rrn, cmlA, marA, ompF, |
| Chloramphenicol, 1947 | preventing peptide translocation/binds to S6, L3, L6, L14, L16, L25, L26, L27, but preferentially to L16 | ompR |
| Tetracyclines, 1948, type II | Binding to 30S ribosomal subunit, "A" site | clmA (cmr), mar, ompF |
| polyketides | on 30S subunit, blocks peptide elongation, | |
| Minocycline | strongest binding to S7 | |
| Doxycycline | | |
| Macrolides (type I polyketides) | Binding to 50 S ribosomal subunit, 23S | rrn, rplC, rplD, rplV, |
| Erythromycin, 1950 | rRNA, blocks peptide translocation, L15, | mac |
| Carbomycin, Spiramycin etc | L4, L12 | |
| Aminoglycosides Streptomycin, 1944 | Irreversible binding to 30S ribosomal subunit, prevents translation or causes | rpsl, strC,M, ubiF atpA-E, ecfB, |
| Neomycin | mistranslation of mRNA/16S rRNA | hemAC,D,E,G, topA, |
| Spectinomycin | | rpsC,D,E, rrn, spcB |
| | | atpA-atpE, cpxA, ecfB, |
| | | hemA,B,L, topA |
| Kanamycin | | ksgA,B,C,D, rplB,K, |
| | | rpsI,N,M,R |
| Kasugamycin | | rplF, ubiF |
| | | epxA |
| Gentamicin, 1963 | | rpsL |
| Amikacin | | |
| Paromycin | | |
| Lincosamides | Binding to 50 S ribosomal subunit, blocks | linB, rplN,O, rpsG |
| Lincomycin, 1955 | peptide translocation | |
| Clindamycin | | |
| Streptogramins Virginiamycin, | 2 components, Streptogramins A & B, bind | |
| 1955 Pristinamycin | to the 50S ribosomal subunit blocking | |
| Synercid: quinupristin/ | peptide translocation and peptide bond | |
| dalfopristin | formation | |
| Fusidanes | Inhibition of elongation factor G (EF-G) | fusA |
| Fusidic Acid | prevents peptide translocation | |
| Kirromycin (Mocimycin) | Inhibition of elongation factor TU (EF-Tu), prevents peptide bond formation | nfA.B |
| Pulvomycin | Binds to and inhibits EF-TU | |
| Thiopeptin | Sulfur-containing antibiotic, inhibits protein synthesis, EF-G | rplE |
| Tiamulin | Inhibits protein synthesis | rplC, rplD |
| Negamycin | Inhibits termination process of protein synthesis | prfB |
| Oxazolidinones Linezolid | 23S rRNA | pdx |
| Isoniazid | | |
| Nitrofurantoin | Inhibits protein synthesis, nitroreductases convert nitrofurantoin to highty reactive electrophilic intermediates which attack bacterial ribosomal proteins non-specifically | nfnA,B |
| Pseudomonic Acids Mupirocin (Bactroban) | Inhibition of isoleucyl tRNA synthetase-used for Staph, topical cream, nasal spray | tleS |

-continued

| ANTIBIOTIC | INHIBITS/TARGET | RESISTANT MUTANTS |
|---|---|---|
| Indolmycin | Inhibits tryptophanyl-tRNA synthetase | trpS |
| Viomycin | | rrmA (23S rRNA methyltransferase, mutant has slow growth rate, slow chain elongation rate, and viomycin resistance) |
| Thiopeptides | Binds to L11-23S RNA complex | |
| Thiostrepton | Inhibits GTP hydrolysis by EF-G | |
| Micrococcin | Stimulates GTP hydrolysis by EF-G | |
| Inhibitors of Cell Walls/Membranes | | |
| β-lactams | Inhibition of one or more cell wall | |
| Penicillin, 1929 Ampicillin | transpeptidases, endopeptidases, and | ampC, ampD, ampE, |
| Methicillin, 1960 | glycosidases (PBPs), of the 12 PBPs only 2 are essential: mrdA (PBP2) and ftsl (phyB, PBP3) | envZ, galU, hipA, hipQ, ampC, ampF, ompR, ptsl, rfa, tolD, tolE |
| Cephalosporins, 1962 | | tonB |
| Mecillinam (amdinocillin) | Binds to and inactivates PBP2 (mrdA) Inactivates PBP3 (fisl) | alaS, argS, crp, cyaA, envB, mrdA,B, |
| Aztreonam (Furazlocillin) | | mreB,C,D |
| Bacilysin, Tetaine | Dipeptide, inhib glucosamine synthase | dppA |
| Glycopeptides Vancomycin, 1955 | Inhib G+ cell wall syn, binds to terminal D-ala-D-ala of pentapeptide. | |
| Polypeptides Bacitracin | Prevents dephosphorylation and regeneration of lipid carrier | rfa |
| Cyclic lipopeptide Daptomycin, 1980 | Disrupts multiple aspects of membrane function, including peptidoglycan synthesis, lipoteichoic acid synthesis, and the bacterial membrane potential | |
| Cyclic polypeptides Polymixin, 1939 | Surfactant action disrupts cell membrane lipids, binds lipid A mioety of LPS | pmrA |
| Fosfomycin, 1969 | Analogue of P-enolpyruvate, inhibits $1^{st}$ step in peptidoglycan synthesis - UDP-N-acetylglucosamine enolpyruvyl transferase, murA, Also acts as Immunosuppressant | murA, crp, cyaA glpT, hipA, ptsl, uhpT |
| Cycloserine | Prevents formation of D-ala dimer, inhibits D-ala ligase, ddlA,B | hipA, cycA |
| Alafosfalin | phosphonodipeptide, cell wall synthesis inhibitor, potentiator of β-lactams | pepA, tpp |
| Inhibitors of Protein Processing/Transport | | |
| Globomycin | Inhibits signal peptidase II (cleaves prolipoproteins subsequent to lipid modification, IspA | tpp, dnaF, |

Example 12
Transfer of Exogenous Nucleic Acid Sequences to Other Bacterial Species Using the E. coli Expression Vectors or Expression Vectors Functional in Bacterial Species Other than E. Coli.

The above methods were validated using antisense nucleic acids which inhibit the growth of E. coli which were identified using methods similar to those described above. Expression vectors which inhibited growth of E. coli upon induction of antisense RNA expression with IPTG were transformed directly into Enterobacter cloacae, Klebsiella pneumoniae or Salmonella typhimurium. The transformed cells were then assayed for growth inhibition according to the method of Example 1. After growth in liquid culture, cells were plated at various serial dilutions and a score determined by calculating the log difference in growth for INDUCED vs. UNINDUCED antisense RNA expression as determined by the maximum 10 fold dilution at which a colony was observed. The results of these experiments are listed below in Table VI. If there was no effect of antisense RNA expression in an organism, the clone is minus in Table VI. In contrast, a positive in Table VI means that at least 10 fold more cells were required to observe a colony on the induced plate than on the non-induced plate under the conditions used and in that organism.

Sixteen of the constructs were found to inhibit growth in all the organisms tested upon induction of antisense RNA expression with IPTG. Those skilled in the art will appreciate that a negative result in a heterologous organism does not mean that that organism is missing that gene nor does it mean that the gene is unessential. However, a positive result means that the heterologous organism contains a homologous gene which is required for proliferation of that organism. The homologous gene may be obtained using the methods described herein. Those cells that are inhibited by antisense may be used in cell based assays as described herein for the identification and characterization of compounds in order to develop antibiotics effective in these organisms. Those skilled in the art will appreciate that an antisense molecule which works in the organism from which it was obtained will not always work in a heterologous organism.

TABLE VI

Sensitivity of Other Microorganisms to Antisense Nucleic Acids That Inhibit Proliferation in E. coli

| Mol. No. | S. typhimurium | E. cloacae | K. pneunioniae |
|---|---|---|---|
| EcXA001 | + | + | − |
| EcXA004 | − | − | − |
| EcXA005 | + | + | + |
| EcXA006 | − | − | − |
| EcXA007 | − | + | − |
| EcXA008 | + | − | + |
| EcXA010 | + | + | + |
| EcXA011 | − | + | − |
| EcXA012 | − | + | − |
| EcXA013 | + | + | + |
| EcXA014 | + | + | − |
| EcXA015 | − | + | + |
| EcXA016 | + | + | + |
| EcXA017 | + | + | + |
| EcXA018 | + | + | + |
| EcXA019 | + | + | + |
| EcXA020 | + | + | + |
| EcXA021 | + | + | + |
| EcXA023 | + | + | + |
| EcXA024 | + | − | + |
| EcXA025 | − | − | − |
| EcXA026 | + | + | − |
| EcXA027 | + | + | + |
| EcXA028 | + | − | − |
| EcXA029 | − | − | − |
| EcXA030 | + | + | + |
| EcXA031 | + | − | − |
| EcXA032 | + | − | − |
| EcXA033 | + | + | + |
| EcXA034 | + | + | + |
| EcXA035 | − | − | − |
| EcXA036 | + | − | + |
| EcXA037 | − | + | − |
| EcXA038 | + | + | − |
| EcXA039 | + | − | − |
| EcXA041 | + | + | + |
| EcXA042 | − | + | + |
| EcXA044 | − | − | − |
| EcXA045 | − | + | − |
| EcXA046 | − | − | − |
| EcXA047 | + | + | − |
| EcXA048 | − | − | − |
| EcXA049 | + | − | − |
| EcXA050 | − | − | − |
| EcXA051 | + | − | − |
| EcXA052 | + | − | − |
| EcXA053 | + | + | + |
| EcXA054 | − | − | + |
| EcXA055 | + | − | − |

Example 13
Use of Identified Exogenous Nucleic Acid Sequences as Probes

The identified sequence of the present invention can be used as probes to obtain the sequence of additional genes of interest from a second organism. For example, probes to potential bacterial target proteins may be hybridized to nucleic acids from other organisms including other bacteria and higher organisms, to identify homologous sequences. Such hybridization might indicate that the protein encoded by the gene to which the probe corresponds is found in humans and therefore not necessarily a good drug target. Alternatively, the gene can be conserved only in bacteria and therefore would be a good drug target for a broad spectrum antibiotic or antimicrobial.

Probes derived from the identified nucleic acid sequences of interest or portions thereof can be labeled with detectable labels familiar to those skilled in the art, including radio-isotopes and non-radioactive labels, to provide a detectable probe. The detectable probe can be single stranded or double stranded and can be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it can be denatured prior to contacting the probe. In some applications, the nucleic acid sample can be immobilized on a surface such as a nitrocellulose or nylon membrane. The nucleic acid sample can comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting. Northern blotting, dot blotting, colony hybridization, and plaque hybridization. In some applications, the nucleic acid capable of hybridizing to the labeled probe can be cloned into vectors such as expression vectors, sequencing vectors, or in vitro transcription vectors to facilitate the characterization and expression of the hybridizing nucleic acids in the sample. For example, such techniques can be used to isolate, purify and clone sequences from a genomic library, made from a variety of bacterial species, which are capable of hybridizing to probes made from the sequences identified in Examples 5 and 6.

Example 14
Preparation of PCR Primers and Amplification of DNA

The identified E. coli genes corresponding directly to or located within the operon of nucleic acid sequences required for proliferation or portions thereof can be used to prepare PCR primers for a variety of applications, including the identification or isolation of homologous sequences from other species, for example S. typhimurium, E. cloacae, and Klebsiella pneumoniae, which contain part or all of the homologous genes. Because homologous genes are related but not identical in sequence, those skilled in the art will often employ degenerate sequence PCR primers. Such degenerate sequence primers are designed based on conserved sequence regions, either known or suspected, such as conserved coding regions. The successful production of a PCR product using degenerate probes generated from the sequences identified herein would indicate the presence of a homologous gene sequence in the species being screened. The PCR primers are at least 10 bases, and preferably at least 20 bases in length. More preferably, the PCR primers are at least 20–30 bases in length. In some embodiments, the PCR primers can be more than 30 bases in length. It is preferred that the primer pairs have approximately the same G/C ratio, so that melting temperatures are approximately the same. A variety of PCR techniques are familiar to those skilled in the art. For a review of PCR technology, see Molecular Cloning to Genetic Engineering White, B. A. Ed. in Methods in Molecular Biology 67: Humana Press, Totowa 1997. When the entire coding sequence of the target gene is known, the 5' and 3' regions of the target gene can be used as the sequence source for PCR probe generation. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to pro-

Example 15
Inverse PCR

The technique of inverse polymerase chain reaction can be used to extend the known nucleic acid sequence identified in Examples 5 and 6. The inverse PCR reaction is described generally by Ochman et al., in Ch. 10 of PCR Technology: Principles and Applications for DNA Amplification, (Henry A. Erlich, Ed.) W. H. Freeman and Co. (1992). Traditional PCR requires two primers that are used to prime the synthesis of complementary strands of DNA. In inverse PCR, only a core sequence need be known. Using the sequences identified as relevant from the techniques taught in Examples 5 and 6 and applied to other species of bacteria, a subset of exogenous nucleic sequences are identified that correspond to genes or operons that are required for bacterial proliferation. In species for which a genome sequence is not known, the technique of inverse PCR provides a method for obtaining the gene in order to determine the sequence or to place the probe sequences in full context to the target sequence to which the identified exogenous nucleic acid sequence binds.

To practice this technique, the genome of the target organism is digested with an appropriate restriction enzyme so as to create fragments of nucleic acid that contain the identified sequence as well as unknown sequences that flank the identified sequence. These fragments are then circularized and become the template for the PCR reaction. PCR primers are designed in accordance with the teachings of Example 15 and directed to the ends of the identified sequence are synthesized. The primers direct nucleic acid synthesis away from the known sequence and toward the unknown sequence contained within the circularized template. After the PCR reaction is complete, the resulting PCR products can be sequenced so as to extend the sequence of the identified gene past the core sequence of the identified exogenous nucleic acid sequence identified. In this manner, the full sequence of each novel gene can be identified. Additionally the sequences of adjacent coding and noncoding regions can be identified.

Example 16
Identification of Genes Required for *Staphylococcus aureus* Proliferation Genes required for proliferation in *Staphylococcus aureus* are identified according to the methods described above.

Example 17
Identification of Genes Required for *Neisseria gonorrhoeae* Proliferation Genes required for proliferation in *Neisseria gonorrhoeae* are identified according to the methods described above.

Example 18
Identification of Genes Required for *Pseudomonas aeruginosa* Proliferation Genes required for proliferation in *Pseudomonas aeruginosa* are identified according to the methods described above.

Example 19
Identification of Genes Required for *Enterococcus faecalis* Proliferation Genes required for proliferation in *Enterococcus faecalis* are identified according to the methods described above.

Example 20
Identification of Genes Required for *Haemophilus influenzae* Proliferation Genes required for proliferation in *Haemophilus influenzae* are identified according to the methods described above.

Example 21
Identification of Genes Required for *Salmonella typhimurium* Proliferation Genes required for proliferation in *Salmonella typhimurium* are identified according to the methods described above.

Example 22
Identification of Genes Required for *Helicobacter pylori* Proliferation Genes required for proliferation in Helicobacter pyloriare identified according to the methods described above.

Example 23
Identification of Genes Required for *Mycoplasma pneumoniae* Proliferation Genes required for proliferation in *Mycoplasma pneumoniae* are identified according to the methods described above.

Example 24
Identification of Genes Required for *Plasmodium ovale* Proliferation Genes required for proliferation in *Plasmodium ovale* are identified according to the methods described above.

Example 25
Identification of Genes Required for *Saccharomyces cerevisiae* Proliferation Genes required for proliferation in *Saccharomyces cerevisiae* are identified according to the methods described above.

Example 26
Identification of Genes Required for *Entamoeba histolytica* Proliferation Genes required for proliferation in *Entamoeba histolytica* are identified according to the methods described above.

Example 27
Identification of Genes Required for *Candida albicans* Proliferation Genes required for proliferation in *Candida albicans* are identified according to the methods described above.

Example 28
Identification of Genes Required for *Klebsiella pneumoniae* Proliferation Genes required for proliferation in *Klebsiella pneumoniae* are identified according to the methods described above.

Example 29
Identification of Genes Required for *Salmonella typhi* Proliferation Genes required for proliferation in *Salmonella typhi* are identified according to the methods described above.

Example 30
Identification of Genes Required for *Salmonella paratyphi* Proliferation Genes required for proliferation in *Salmonella paratyphi* are identified according to the methods described above.

Example 31
Identification of Genes Required for *Salmonella cholerasuis* Proliferation Genes required for proliferation in *Salmonella cholerasuis* are identified according to the methods described above.

Example 32
Identification of Genes Required for *Staphylococcus epidermis* Proliferation Genes required for proliferation in *Staphylococcus epidermis* are identified according to the methods described above.

Example 33
Identification of Genes Required for *Mycobacterium tuberculosis* Proliferation Genes required for proliferation in *Mycobacterium tuberculosis* are identified according to the methods described above.

Example 34
Identification of Genes Required for *Mycobacterium leprae* Proliferation Genes required for proliferation in *Mycobacterium leprae* are identified according to the methods described above.

Example 35
Identification of Genes Required for *Treponema pallidum* Proliferation Genes required for proliferation in *Treponema pallidum* are identified according to the methods described above.

Example 36
Identification of Genes Required for *Bacillus anthracis* Proliferation Genes required for proliferation in *Bacillus anthracis* are identified according to the methods described above.

Example 37
Identification of Genes Required for *Yersinia pestis* Proliferation Genes required for proliferation in *Yersinia pestis* are identified according to the methods described above.

Example 38
Identification of Genes Required for *Clostridium botulinum* Proliferation Genes required for proliferation in *Clostridium botulinum* are identified according to the methods described above.

Example 39
Identification of Genes Required for *Campylobacter jejuni* Proliferation Genes required for proliferation in *Campylobacter jejuni* are identified according to the methods described above.

Example 40
Identification of Genes Required for *Chlamydia trachomatus*

Proliferation

Genes required for proliferation in *Chlamydia trachomatus* are identified according to the methods described above.

Use of Isolated Exogenous Nucleic Acid Fragments as Antisense Antibiotics

In addition to using the identified sequences to enable screening of molecule libraries to identify compounds useful to identify antibiotics, the sequences themselves can be used as therapeutic agents. Specifically, the identified exogenous sequences in an antisense orientation can be provided to an individual to inhibit the translation of a bacterial target gene.

Generation of Antisense Therapeutics from Identified Exogenous Sequences

The sequences of the present invention can be used as antisense therapeutics for the treatment of bacterial infections or simply for inhibition of bacterial growth in vitro or in vivo. The therapy exploits the biological process in cells where genes are transcribed into messenger RNA (mRNA) that is then translated into proteins. Antisense RNA technology contemplates the use of antisense oligonucleotides directed against a target gene that will bind to its target and decrease or inhibit the translation of the target mRNA. In one embodiment, antisense oligonucleotides can be used to treat and control a bacterial infection of a cell culture containing a population of desired cells contaminated with bacteria. In another embodiment, the antisense oligonucleotides can be used to treat an organism with a bacterial infection.

Antisense oligonucleotides can be synthesized from any of the sequences of the present invention using methods well known in the art. In a preferred embodiment, antisense oligonucleotides are synthesized using artificial means. Uhlmann & Peymann, Chemical Rev. 90:543–584 (1990) review antisense oligonucleotide technology in detail. Modified or unmodified antisense oligonucleotides can be used as therapeutic agents. Modified antisense oligonucleotides are preferred since it is well known that antisense oligonucleotides are extremely unstable. Modification of the phosphate backbones of the antisense oligonucleotides can be achieved by substituting the internucleotide phosphate residues with methyl phosphonates, phosphorothioates, phosphoramidates, and phosphate esters. Nonphosphate internucleotide analogs such as siloxane bridges, carbonate brides, thioester bridges, as well as many others known in the art. The preparation of certain antisense oligonucleotides with modified internucleotide linkages is described in U.S. Pat. No. 5,142,047, hereby incorporated by reference.

Modifications to the nucleoside units of the antisense oligonucleotides are also contemplated. These modifications can increase the half-life and increase cellular rates of uptake for the oligonucleotides in vivo. For example, α-anomeric nucleotide units and modified bases such as 1,2-dideoxy-d-ribofuranose, 1,2-dideoxy-1-phenylribofuranose, and $N^4,N^4$-ethano-5-methyl-cytosine are contemplated for use in the present invention.

An additional form of modified antisense molecules is found in peptide nucleic acids. Peptide nucleic acids (PNA) have been developed to hybridize to single and double stranded nucleic acids. PNA are nucleic acid analogs in which the entire deoxyribose-phosphate backbone has been exchanged with a chemically completely different, but structurally homologous, polyamide (peptide) backbone containing 2-aminoethyl glycine units. Unlike DNA, which is highly negatively charged, the PNA backbone is neutral. Therefore, there is much less repulsive energy between complementary strands in a PNA-DNA hybrid than in the comparable DNA-DNA hybrid, and consequently they are much more stable. PNA can hybridize to DNA in either a Watson/Crick or Hoogsteen fashion (Demidov et al., *Proc. Natl. Acad. Sci. U.S.A.* 92:2637–2641, 1995: Egholm, *Nature* 365:566–568, 1993; Nielsen et al., *Science* 254:1497–1500, 1991; Dueholm et al., *New J. Chem.* 21:19–31, 1997).

Molecules called PNA "clamps" have been synthesized which have two identical PNA sequences joined by a flexible hairpin linker containing three 8-amino-3,6-dioxaoctanoic acid units. When a PNA clamp is mixed with a complementary homopurine or homopyrimidine DNA target sequence, a PNA-DNA-PNA triplex hybrid can form which has been shown to be extremely stable (Bentin et al.,

*Biochemistry* 35:8863–8869, 1996; Egholm et al., *Nucleic Acids Res.* 23:217–222, 1995; Griffith et al., *J. Am. Chem. Soc.* 117:831–832, 1995).

The sequence-specific and high affinity duplex and triplex binding of PNA have been extensively described (Nielsen et al., *Science* 254:1497–1500, 1991; Egholm et al., *J. Am. Chem. Soc.* 114:9677–9678, 1992; Egholm et al., *Nature* 365:566–568, 1993; Almarsson et al., *Proc. Natl. Acad. Sci. U.S.A.* 90:9542–9546, 1993; Demidov et al., *Proc. Natl. Acad. Sci. U.S.A.* 92:2637–2641, 1995). They have also been shown to be resistant to nuclease and protease digestion (Demidov et al., *Biochem. Pharm.* 48:1010–1313, 1994). PNA has been used to inhibit gene expression (Hanvey et al., *Science* 258:1481–1485,1992; Nielsen et al., *Nucl. Acids. Res.,* 21:197–200, 1993; Nielsen et al., *Gene* 149:139–145, 1994; Good & Nielsen, Science. 95: 2073–2076, 1998; all of which are hereby incorporated by reference), to block restriction enzyme activity (Nielsen et al., supra., 1993), to act as an artificial transcription promoter (Mollegaard, *Proc. Natl. Acad. Sci. U.S.A.* 91:3892–3895, 1994) and as a pseudo restriction endonuclease (Demidov et al., *Nuc. Acids. Res.* 21:2103–2107, 1993). Recently, DNA has also been shown to have antiviral and antitumoral activity mediated through an antisense mechanism (Norton, *Nature Biotechnol.,* 14:615–619, 1996; Hirschmann et al., *J. Investig. Med.* 44:347–351, 1996). PNAs have been linked to various peptides in order to promote PNA entry into cells (Basu et al., *Bioconj. Chem.* 8:481–488, 1997; Pardridge et al., *Proc. Natl. Acad. Sci. U.S.A.* 92:5592–5596, 1995).

The antisense oligonucleotides contemplated by the present invention can be administered by direct application of oligonucleotides to a target using standard techniques well known in the art. The antisense oligonucleotides can be generated within the target using a plasmid, or a phage. Alternatively, the antisense nucleic acid may be expressed from a sequence in the chromosome of the target cell. It is further contemplated that contemplated that the antisense oligonucleotide contemplated are incorporated in a ribozyme sequence to enable the antisense to specifically bind and cleave its target mRNA. For technical applications of ribozyme and antisense oligonucleotides see Rossi et al., Pharmacol. Ther. 50(2):245–254, (1991), which is hereby incorporated by reference. The present invention also contemplates using a retron to introduce an antisense oligonucleotide to a cell. Retron technology is exemplified by U.S. Pat. No. 5,405,775, which is hereby incorporated by reference. Antisense oligonucleotides can also be delivered using liposomes or by electroporation techniques which are well known in the art.

The antisense nucleic acids of the present invention can also be used to design antibiotic compounds comprising nucleic acids which function by intracellular triple helix formation. Triple helix oligonucleotides are used to inhibit transcription from a genome. The sequences identified as required for proliferation in the present invention, or portions thereof, can be used as templates to inhibit microorganism gene expression in individuals infected with such organisms. Traditionally, homopurine sequences where considered the most useful for triple helix strategies. However, homopyrimidine sequences can also inhibit gene expression. Such homopyrimidine oligonucleotides bind to the major groove at homopurine:homopyrimidine sequences. Thus, both types of sequences based on the sequences of the present invention that are required for proliferation are contemplated for use as antibiotic compound templates.

The antisense oligonucleotides of this example employ the identified sequences of the present invention to induce bacterial cell death or at least bacterial stasis by inhibiting target gene translation. Antisense oligonucleotides containing from about 8 to 40 bases of the sequences of the present invention have sufficient complementary to form a duplex with the target sequence under physiological conditions.

To kill bacterial cells or inhibit their growth, the antisense oligonucleotides are applied to the bacteria or to the target cells under conditions that facilitate their uptake. These conditions include sufficient incubation times of cells and oligonucleotides so that the antisense oligonucleotides are taken up by the cells. In one embodiment, an incubation period of 7–10 days is sufficient to kill bacteria in a sample. An optimum concentration of antisense oligonucleotides is selected for use.

The concentration of antisense oligonucleotides to be used can vary depending on the type of bacteria sought to be controlled, the nature of the antisense oligonucleotide to be used, and the relative toxicity of the antisense oligonucleotide to the desired cells in the treated culture. Antisense oligonucleotides can be introduced to cell samples at a number of different concentrations preferably between $1 \times 10^{-10}$M to $1 \times 10^{-4}$M. Once the minimum concentration that can adequately control gene expression is identified, the optimized dose is translated into a dosage suitable for use in vivo. For example, an inhibiting concentration in culture of $1 \times 10^{-7}$ translates into a dose of approximately 0.6 mg/kg body weight. Levels of oligonucleotide approaching 100 mg/kg body weight or higher may be possible after testing the toxicity of the oligonucleotide in laboratory animals. It is additionally contemplated that cells from the subject are removed, treated with the antisense oligonucleotide, and reintroduced into the subject. This range is merely illustrative and one of skill in the art are able to determine the optimal concentration to be used in a given case.

After the bacterial cells have been killed or controlled in a desired culture, the desired cell population may be used for other purposes.

Example 41

The following example demonstrates the ability of an *E. coli* antisense oligonucleotide to act as a bactericidal or bacteriostatic agent to treat a contaminated cell culture system. The application of the antisense oligonucleotides of the present invention are thought to inhibit the translation of bacterial gene products required for proliferation.

The antisense oligonucleotide of this example corresponds to a 30 base phophorothioate modified oligodeoxynucelotide complementary to a nucleic acid involved in proliferation, such as Molecule Number EcXA001. A sense oligodeoxynucelotide complementary to the antisense sequence is synthesized and used as a control. The oligonucleotides are synthesized and purified according to the procedures of Matsukura. et al., Gene 72:343 (1988). The test oligonucleotides are dissolved in a small volume of autoclaved water and added to culture medium to make a 100 micromolar stock solution.

Human bone marrow cells are obtained from the peripheral blood of two patients and cultured according standard procedures well known in the art. The culture is contaminated with the K-12 strain of *E. coli* and incubated at 37° C. overnight to establish bacterial infection.

The control and antisense oligonucleotide containing solutions are added to the contaminated cultures and monitored for bacterial growth. After a 10 hour incubation of culture and oligonucleotides, samples from the control and experimental cultures are drawn and analyzed for the translation of the target bacterial gene using standard microbiological techniques well known in the art. The target *E. coli* gene is found to be translated in the control culture treated with the control oligonucleotide, however, translation of the target gene in the experimental culture treated with the antisense oligonucleotide of the present invention is not detected or reduced.

Example 42

A subject suffering from an *E. coli* infection is treated with the antisense oligonucleotide preparation of Example 39. The antisense oligonucleotide is provided in a pharmaceutically acceptable carrier at a concentration effective to inhibit the translation of the target gene. The present subject is treated with a concentration of antisense oligonucleotide sufficient to achieve a blood concentration of about 100 micromolar. The patient receives daily injections of antisense oligonucleotide to maintain this concentration for a period of 1 week. At the end of the week a blood sample is drawn and analyzed for the presence or absence using, standard techniques well known in the art. There is no detectable evidence of *E. coli* and the treatment is terminated.

Example 43
Preparation and Use of Triple Helix Probes

The sequences of microorganism genes required for proliferation of the present invention are scanned to identify 10-mer to 20-mer homopyrimidine or homopurine stretches that could be used in triple-helix based strategies for inhibiting gene expression. Following identification of candidate homopyrimidine or homopurine stretches, their efficiency in inhibiting gene expression is assessed by introducing varying amounts of oligonucleotides containing the candidate sequences into a population of bacterial cells that normally express the target gene. The oligonucleotides may be prepared on an oligonucleotide synthesizer or they may be purchased commercially from a company specializing in custom oligonucleotide synthesis, such as GENSET, Paris, France.

The oligonucleotides can be introduced into the cells using a variety of methods known to those skilled in the art, including but not limited to calcium phosphate precipitation, DEAE-Dextran, electroporation, liposome-mediated transfection or native uptake.

Treated cells are monitored for a reduction in proliferation using techniques such as monitoring growth levels as compared to untreated cells using optical density measurements. The oligonucleotides that are effective in inhibiting gene expression in cultured cells can then be introduced in in vivo using the techniques well known in that art at a dosage level shown to be effective.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (Science 245:967–971 (1989), which is hereby incorporated by this reference).

Example 44
Identification of Bacterial Strains from Isolated Specimens by PCR Classical bacteriological methods for the detection of various bacterial species are time consuming and costly. These methods include growing the bacteria isolated from a subject in specialized media, cultivation on selective agar media, followed by a set of confirmation assays that can take from 8 to 10 days or longer to complete. Use of the identified sequences of the present invention provides a method to dramatically reduce the time necessary to detect and identify specific bacterial species present in a sample.

In one exemplary method, bacteria are grown in enriched media and DNA samples are isolated from specimens of, for example, blood, urine, stool, saliva or central nervous system fluid by conventional methods. A panel of PCR primers based on identified sequences unique to various species of microorganisms are then utilized in accordance with Example 12 to amplify DNA of approximately 100–200 bases in length from the specimen. A separate PCR reaction is set up for each pair of PCR primers and after the PCR reaction is complete, the reaction mixtures are assayed for the presence of PCR product. The presence or absence of bacteria from the species to which the PCR primer pairs belong is determined by the presence or absence of a PCR product in the various test PCR reaction tubes.

Although the PCR reaction is used to assay the isolated sample for the presence of various bacterial species, other assays such as the Southern blot hybridization are also contemplated.

All documents cited herein are incorporated herein by reference in their entireties.

SEQUENCE LISTING (485 sequences)

SEQ ID NO: 1 - DNA, 159 bp, E. Coli
caggtggtatggaaacccaaaatggagacgggaagctgaaccagatagttactggaggtgatcaccagcagatgaaataacgataaccagaacaacgccttatagcgttgagtttgcgagaaaacgttcatattgtacctttttgattaaccattgggg

SEQ ID NO: 2 - DNA, 696 bp, E. Coli
  misc_feature (1)...(696): n = A,T,C or G
gattacatcaagcgcgcggtgggtttaccgggcgataaagtcacttacgatccggtctcaaaagagctgacgattcaaccgggatgcagttccggccaggcgtgtgaaaacgcgctgccggtcacctactcaaacgtggaaccgagcgatttcgttcagaccttctcacgccgtaatggtggggaagcgaccagcggattctttgaagtgccgaaaaacgaaaccaaagaaaatggaattcgtctttccgagcgtaaagagacactgggtgatgtgacgcaccgcattctgacagtgccgattgcgcaggatcaggtggggatgtattaccagcagccagggcaacaactggcaacctggattgttcctccgggacaatacttcatgatgggcgacaaccgcgacaacagcgcggacagccgttactggggctttgtgccngaagcgaatctggtcggtcnggcaacggctatctggatgaacttcgataaccaagaaggcgaatggccgaatggtctgccctaantcgcattggcgnntccnttaatanccacttccttcnctttgtccccttatggcaacacttaatttattntaaantaatcncccgtggctnacaaatccccgccttttnttaaaaatttccccnaanttaaggttggcctccagttgcccgncccaaacactttggncccc

SEQ ID NO: 3 - DNA, 681 bp, E. Coli
  misc_feature (1)...(681): n = A,T,C or G
ctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcnattataccngtaaccggcactacagcacacgtagaaagcacccgacaatactcctggcatgggcgttaaagctcacaggatggagatcttttcttcactggcctaaaaagctgatattctgtaaagagttacacngtaacattgagatcgctatgaaatatcaacaacttggaaaatcttgnaaagcnggttggaaaatggaaagtatctggttaagaagc

SEQ ID NO: 4 - DNA, 289 bp, E. Coli
ggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgtcacggatcaggatcacggagtgctcct

SEQ ID NO: 5 - DNA, 815 bp, E. Coli
  misc_feature (1)...(815): n = A,T,C or G
gggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctgaaagcacagttcgaagaagaacgtgttgcgctggtagcgaaaattggtgaaaacatcaacattcgccgcgttgctgcgctggaaggcgacgttctgggttcttatcagcacggtgcgcgtatcggccgttctggttgctgctaaaagcgctgacgaagaactggttaaacacatcgttttgacctttgttgcaagccaagccagaattcagagaaactttccgcttcaccggaggtcccacccacangganccccgattttntcagcatggtggtcttcctncggagtt

SEQ ID NO: 6 - DNA, 403 bp, E. Coli
caacactattttgttgaccggaaaatggaacactttccgcaatgcctgttgctatcacgcttaaaccatttcattgcgatttacacagaacggacgtcctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcg

SEQ ID NO: 7 - DNA, 149 bp, E. Coli
gagcttttttcagtgcttctgcgtcgtctttgctcacgccttctttcagagcagccggtgcagattctaccaggtctttagcttctttcagacccaggccagttgcgccacgtactgctttgataacagcaactttgttagcgccagca

SEQ ID NO: 8 - DNA, 742 bp, E. Coli
  misc_feature (1)...(742): n = A,T,C or G
ccatctgtccattgagcggacagtttgtgcaacactattttgttgaccggaaaatggaacactttccgcaatgcctgttgctatcacgcttaaaccatttcattgcgatttacacagaacggacgtcctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcgccacgtactgctttgataacagcaactttgttagcgccagcagctttcagaattacgtcgaattcagttntttcttcagcagcttcaaccgggccagcagctacagctacagcagcagcaagcggaaacaccgaatttttcttccattgcagagatcagttctacaaccgtccattacagacatagctgcaactgcttcaatgattttgatctttagtggatagacatttaaattgttcctgaattatcaagaaataagtnttatacgtaagccgaaatgcgttaaaaaagataactgngattaaagcag

SEQ ID NO: 9 - DNA, 421 bp, E. Coli
agtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcgccacgtactgctttgataacagcaactttgttagcgccagcagctttcagaattacgtcgaattcagttttttcttcagcagcttcaaccgggccagcagctacagctacagcagcagcagcggaaacaccgaatttttcttccattgcagagatcagttctacaac

SEQ ID NO: 10 - DNA, 126 bp, E. Coli
agagcttttttcagtgcttctgcgtcgtctttgctcacgccttctttcagagcagccggtgcagattctaccaggtctttagcttctttcagacccaggccagttgcgccacgtactgctttgata

SEQ ID NO: 11 - DNA, 262 bp, E. Coli
  misc_feature (1)...(262): n = A,T,C or G
ctgcaaccggaagggttggcttatttaacttcaacttcagcgccagcttcttccagagcttttttcagtgcttctgcgtcgtctttgctcacgccttctttcagagcagccgntgcagattctaccaggtctttagcttctttcagacccaggccagttgcgccacgtactgctttgataacagcaactttgttagcgccagcagctttcagaattacgtcgaattcagttttttcttcagcagcttcaaccgggccagcag

SEQ ID NO: 12 - DNA, 202 bp, E. Coli
  misc_feature (1)...(202): n = A,T,C or G
gcgcataccctgcagcatcggcccgatggagatcaggtcggcagaacgctgtaccgctttgtaggtggtgttaccggtgntcagatccgggaagatgaacacggtagcgcgacctgcaaccggagagttcggcgctttggattncgcaacgtcagccattaccgcagcgtcgtactgcagcggaccggcgatcatcaggtca

SEQ ID NO: 13 - DNA, 261 bp, E. Coli
tctaggagtaagaatagcttcaaattcagcagttgacagtggcataaacgtaactggtgacttttgcccggcatgacgccgggctttttttattattccgtgacttccagcgtagtgaaggcaaacttctcgccatcaaatagcccctgactggttagttttagcgcggggatcactggcagagaaagaaacgccatctgaataaacggctcatcgggtaacggaccgcattcacgggcggcggctttcaaggcgtcaatt

SEQ ID NO: 14 - DNA, 224 bp, E. Coli
ttctttttttcgtcaacggtgtccagaatcattttatttacctcggggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttg

SEQ ID NO: 15 - DNA, 232 bp, E. Coli
aattcccttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttggg

SEQ ID NO: 16 - DNA, 212 bp, E. Coli
aatagcgggtatgcacgcctttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaa

SEQ ID NO: 17 - DNA, 433 bp, E. Coli
ccttgtaaattatcgcccgtggcataaaaactgcgtccaaacgccgtctttgccagcagccaggccataaatgccaccagaattatcgtcaaccaaccaattgctgaaacgccaagcagcagcggggcggagagctgtttcagttcggcgggtaacccttcaatccatttgccgccagtccacagcaacatgatgcctctgtacaaccctaacgtgccaagggtggcaacaatggcagggatctttagccacgcgaccaggacaccgttgaaaaatcccgcgagcaaaccaagcagtaaagtcgcgacacaagcaacaggtagtgaatatcctgcgttcagtaacatccccaacagcaccgcgcacattccggtaatcgaacccactgaaacatcaatattgcgcgtaagcattaccagcgtcgcgcccattg

SEQ ID NO: 18 - DNA, 658 bp, E. Coli
cgtgcgcttccggttgtggcaacccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcaagtggtcacaggacaatgcaggagtgtatgact

SEQ ID NO: 19 - DNA, 588 bp, E. Coli
  misc_feature (1)...(588): n = A,T,C or G
gtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcangagtgtatgactgcagcaacccgaacagaaaattcccggtaactgttacccggtcgataaagttattcaccaggataatatcgaaatcccggcaggtctttaaaacagttccgtaataaat

SEQ ID NO: 20 - DNA, 101 bp, E. Coli
gatccagcaagaagatgcggttgtaccgtcatcacgcagatgcgcaaagctactcagcaactgacctttcttcgcaataagcacgccattagcgtcataga

SEQ ID NO: 21 - DNA, 465 bp, E. Coli
tcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacgg

SEQ ID NO: 22 - DNA, 859 bp, E. Coli
  misc_feature (1)...(859): n = A,T,C or G
tgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacgggccanagccagacccattttttcctggtcagctttggttttcggtcaactgcgatggagattaccggctcanggaatttccataccttccaggaatgatcggcgcattccggtcaaacanggngtaccaggggggtacntntttttaanancgattgccagcancggatntnncccgngccnaacttctttggaacnntttaccggttggtaaccngccttttnaacnatccaaccgaaaaagngttaanngccanttttccnggngttnanntncggnttcccngaantaacccncccggggtnaacccngnaaaa

SEQ ID NO: 23 - DNA, 269 bp, E. Coli
ctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataaca

SEQ ID NO: 24 - DNA, 330 bp, E. Coli
gttttggggagatgtaagggctaatctgaatggctgcattccttgtttaaggaaaaacgaatgactgattgccgatacctgattaaacgggtcatcaaaatcatcattgctgttttacagctgatccttctgttcttataacacaaggaaacgtacttaaggtgcgtccggtgaaccagtcggacgcacctttaataactataaataagtgtctgggcagatactatataaattaacttagtgaatgattatgctaatgtcatcaattaaataaatataatggcgttaaggcttcccagtaatataattaatactctacttccagagtag

SEQ ID NO: 25 - DNA, 471 bp, E. Coli
  misc_feature (1)...(471): n = A,T,C or G
gttttggggagatgtaagggctaatctgaatggctgcattccttgtttaaggaaaaacgaatgactgattgccgatacctgattaaacgggtcatcaaaatcatcattgctgttttacagctgatccttctgttcttataacacaaggaaacgtacttaaggtgccgtccggtgaaccagtcggacgcacctttaataactataaataagtgtctgggcagatactatataaattaacttagtgaatgattatgctaatgtcatcaattaaataaatataatggcgttaaggcttcccagtaatataattaatactctacttccagagtagaatattaaattttatccgcgtggtgcatcagcacaaatttatcccacaactgttcttctgtctcgacatgccccccgatctttnacaaatantattgggggattnggcccncctttttgncaggttggggtcntctnatg

SEQ ID NO: 26 - DNA, 379 bp, E. Coli
  misc_feature (1)...(379): n = A,T,C or G
natctgantggctgcattccttgtttaaggaaacccgaatgactgattgccgatacctgattaaacgggtcatcaaaatcatcattgctgttttacagctgatccttctgttcttataacacaaggaaacgtacttaaggtgcgtccggtgaaccagtcggacgcacctttaataactataaataagtgtctgggcagatactatataaattaacttagtgaatgattatgctaatgtcatcaattaaataaatataatggcgttaaggcttcccagtaatataattaatactctacttccagagtagaatattaaattttatccgcgtggtgcatcagcacaaatttatcccacaactgttcttctgtctcgacatgc

SEQ ID NO: 27 - DNA, 799 bp, E. Coli
aaagatgatgtgatgagaaagtcaatttgaataagacaatattaagagctaaaaaaatgtcaaaaaacactaaatcaaaaaataatggcattagaaaatataatgcgaaaacggaggtgaaattagtttatttcaaatgaggaaaatctcccggcgaaaaaaccgggagatgaaagtgtgatgggtatcaaataaacaacagaggagaaatttttaacgcagccattcaggcaaatcgtttaatcccattgcctggcggataagttgcggcttaacgccaggaagcgtgtcggccagtttcaaaccaatatcacgcagcagttttttcgccggattggtaccggaaaacagatcgcggaatccctgcataccagccagcatcaacgccgcactgtgcttgcggctacgctcatagcgacgcagataaatgtactgcccgatgtctgggatccgtcgacctgcagccaagcttgggcttttcagcctgatacagattaaatcagaacgcagaagcggtctgataaaacagaatttgcctggcggcagtagcgcggtggtcccacctgaccccatgccgaactcagaagtgaaacgcccgtagcgcccgatggtagtgtggggtctccccatgcgagagtagggaactgccaggcatcaaataaaacgaaaggctcagtcgaaagactgggcctttcggtttatctggtggttgtcggtgaacgctctctgagtaggacaaatccgccgggagcggattttgaacgttgcgaaacaaccggcccggaaaggggtgggggct

SEQ ID NO: 28 - DNA, 636 bp, E. Coli
  misc_feature (1)...(636): n = A,T,C or G
agggggtttgttgtgggcaatgatgcatttaagttatcgtctgcagatagaggagatattacaataaacaacgaatcagggcatttgatagtcaataccgcaattctatcaggagatatagtcactctaagaggaggagaaattaggttggtattatagcttgtgcgcgccatgattggcgcgcaatttaaacttagtgctttacatcgctattgtcttgatttctttgaattattttataaattaaaaaaacgactgttatgtataagcaaaggtcgaacgaaaaatacattccaaataaatgcttgcttaaatctctatatccttccccgaaaaatgacacataaaattgagatattccaaaaagagatactacaaataaagatgcctttattttattatttctaataaaaatagaagcaataaaaaataataacaatgatataaatctaatgtttttaaatatattgtcttttatgttagtaatagtcgttagtatgtttgattctccatatattacgtgtagttttttatatacatggaaataattntctttatactgagacatcacaccatcatcaaatggaagtttgaagatggtgcttggtttgctaaccaataaaaagagtgcattcg

SEQ ID NO: 29 - DNA, 757 bp, E. Coli
  misc_feature (1)...(757): n = A,T,C or G
cagcggtcgtatttttagcatggttttttattggcggctatgctgccccgggagcataaagatgaaaaaaacaacgattattatgatgggtgtggcgattattgtcgtactcggcactgagctgggatggtggtaacgtcacctctaaaaaatagcaaaggctgcctgtgtgcagcctttgtgcaatttaagcgttaacttttaatcttcctgtagataaatagcacgacaatcgcaccaataacggcaaccacgaagctgccaaaattgaagccatcgactttaccaaagccaaacagcgtgctgatccatccgccgactacggcaccgactatccccagcaggatagtcataaagaatccacctccatctttacctggcatgatccacttcgccagaataccggcaataagcccaaaaataatccatgacagaatgcccattgtttcctcacttatctgttttgcattagcgggttagtcgctgataaaaagcatagcacaacatcgggagggcaagatttgtgacgagcatcacggaggttttttttgcgatggcgcagaaattgcgccatcaacgatcagtgataattaccaaccacaaacatcatgttcgttttccgtgtcataagaaccgtacgggattcaccagatcttttatcacttcaagccggcacttctggcaccagcaaagtcatcggcgtctctggttcataatcgaccggaaacgccattgctggtattggtgacngtcacgg

SEQ ID NO: 30 - DNA, 392 bp, E. Coli
aattacagaaaaaggaggcaatatcgggtaaaggcattagcccgacgaatacgtcgggctacaaatattattgtgctgcaggtgttttagcgggttgttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccagttcctgcgcctgatgaatcgcgttatcaatcgctgccttacgcgctttgtctttataggcatccggctgcgccacgcccagcgacacagaacgaatt

SEQ ID NO: 31 - DNA, 351 bp, E. Coli
ctatccttgatgaaaccgcgagcaaagataggtgattacgtcatggttttacagaaaattacagaaaaaggaggcaatatcgggtaaaggcattagcccgacgaatacgtcgggctacaaatattattgtgctgcaggtgttttagcgggttgttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccag

SEQ ID NO: 32 - DNA, 762 bp, E. Coli
  misc_feature (1)...(762): n = A,T,C or G
aattatgaaacactgtctggaatcgtctgaatgacgggcacatttgcgagcacgcatccagtaataacacaggaaactattttatctacgcgttagcgatagactgcttgcatggcgaaaggaggtaagccgacgatttcagcgggacgctgaaacgggaaagcccctcccgaggaaggggccataaataaggaaagggtcatgatgaagctactcatcatcgtggtgctcttagtcataagcttccccgcttactaagactaccagggcgggggaaaccccgctctaccctcactcctgaaagtatgccttcacgataagattgtcaatccgcaggctttgtagtctgcgatcctgccagcaaatattctttgcgagtcgttacgcaataatcacagaggaaactattttattcacgcgttagcgatagactgcattcagggcgaaaggaggtaagccgatgatttcagcgggacgctgaaacgggaaagcctctcccggagaagagggcttttaataaggaaagggttatgatgaagcacgtcatcatactggtgatactcttagtgattagcttccaggcttactaagaacaccagggggagggggaaacctcttcctaaccctcacttctgaaattgggtgctatgacgctggcgttactgcttancgctaccagtttgtctgccctggcggttgtaacgccagatcggtacccgtttggatattttaatgaaagccgacaaatcaatcancgtgacg

SEQ ID NO: 33 - DNA, 293 bp, E. Coli
gcacatttgcgagcacgcatccagtaataacacaggaaactattttatctacgcgttagcgatagactgcttgcatggcgaaaggaggtaagccgacgatttcagcgggacgctgaaacgggaaagcccctcccgaggaaggggccataaataaggaaagggtcatgatgaagctactcatcatcgtggtgctcttagtcataagcttccccgcttactaagactaccagggcgggggaaaccccgctctaccctcactcctgaaagtatgccttcacgataagattgtcaat

SEQ ID NO: 34 - DNA, 633 bp, E. Coli
  misc_feature (1)...(633): n = A,T,C or G
atttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgntattttttattattagccacttgctcgtcttgcttggtattaagtcgtatttcacgttgattaatgcnggtggctccagtgcgccagattaactttgtttggatcgaagacgtagtaactggctggttatcggaattgg

SEQ ID NO: 35 - DNA, 569 bp, E. Coli
tatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgttattttttattattagccacttgctcgtcttgcttgttattagtcgtatttcacgttgattaatgcggttgcctccagtgcgccagatttaactttgtttgtatcgtagacgtagtaactggctggtatcggaat

SEQ ID NO: 36 - DNA, 338 bp, E. Coli
cgtattcacatccttttgattggtgataacatgcgaatcggtattatttttccggttgtaatcttcattacagcggtcgtatttttagcatggttttttattggcggctatgctgccccgggagcataaagatgaaaaaaacaacgattattatgatgggtgtggcgattattgtcgtactcggcactgcctgggatggtggtaacgtcacctctaaaaaatagcaaaggctgcctgtgtgcagcctttgtgcaatttaagcgttaacttttaatcttcctgtagataaatagcacgacaatcgcaccaataacggcaaccacgaagctgccaaaatt

SEQ ID NO: 37 - DNA, 375 bp, E. Coli
ctgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtaca

SEQ ID NO: 38 - DNA, 446 bp, E. Coli
ttacgatagctattagtaaaaatataagagttagctgtattgttatgtctgtggcgaaattgactaccttcgtttttttgattaagaatgattttattatcgtaagtaaaattacatgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttct

SEQ ID NO: 39 - DNA, 392 bp, E. Coli
  misc_feature (1)...(392): n = A,T,C or G
tcaccccggtgccgattttcaggcatcctgatttaacttagcacccgcaacttaactacaggaaaacaaagagataaatgtctaatcctgatgcaaatcgagccgattttttaatctttacggacttttacccgcctggtttattaattgcactgtnatccgggcgttcgcccgctttaatcacaataggctgtgtagcctgggcctgtttctctttcacccgcgccagagcggcagcaatcgcatctttatctttggctgcaggttgaacggctgcgctcttatgtcgttcaaggcgagccgctttttcgcgctccagacgagcctggcgcgcttcgaaacgcgctttggcttctgcggcncgcttttcttcctgacgaatagccgcaatt

SEQ ID NO: 40 - DNA, 208 bp, E. Coli
taataacgctatctgcggataaagcagaataggtggttaaccccagacataaaccgaggaaaataatgttattgtatttcataatctattgttccttagcgacagattgctgtctgctggttcagtaaggtaccaggagaaacttcaggaagcttgtactcgacaatacagtttgagtttttatctttgccccatgaaacctgtaatt

SEQ ID NO: 41 - DNA, 342 bp, E. Coli
catcctcaataccgttaaatgcaacccgaacccccgttgtccctttgctgcattcacttaacgtaatctgaaaagggacggctggacttgtgctaccggtcgttggaaattgtctggcactgtttttttggagatctacggtaaaattaagcgaatccgatgagactgtgcagccataatcgaggacgcgcccgctaattttaataacgctatctgcggataaagcagaataggtggttaaccccagacataaaccgaggaaaataatgttattgtatttcataatctattgttccttagcgacagattgctgtctgctggttcagtaaggtaccaggagaa

SEQ ID NO: 42 - DNA, 841 bp, E. Coli
  misc_feature (1)...(841): n = A,T,C or G
agatttactgccaatttccggcagatcggaaagggttaaaccatattgatccataagggtacgaatcacggctataccgccaggcatggcttgagccatggcattaaattccgcaaattcgggcgctgattcttcccacgcggttattttggcacacaccagatccagcaaggggttntcaggatcgttgagcagcagatgatctaccagttncagcgcctgggtgtattgntccttgttctgaatacccgnnagaaaaggtgccacagcanttagcttntctcctgcttgcaagatgtctggcaatngcaatcattttttgcacttantacgatgnacancngtaaagaaatcgnatttttntatgccgtcataactttacgtatgtancactttttgcnattcnaaaaaagaccattngctncaacacgtaaatttnattgnccccnacatttanaacataaatgnttaaaattttccccccncnnanttttaagntnttnanagaatngggaattacctgcttttnaatgnactcananttttttngnaataattcctntatcnaanctnnttttcncccaanagncnnccaaattncggtttnntnnttnncnnggcntttttttacccnanaanntttattcaannccttttttgtagnctatttnaagnggnctttnttnnattaactttccnnttggncaaattttggcnnatttttatatanaattntcttatntcntaatttnggnanccccngatgnaantttatggngggantcccnntccctntttaatnnatgntctgggntatttttaaancctnnattaannnanc

SEQ ID NO: 43 - DNA, 215 bp, E. Coli
aataacttttcgttaggcagttttgggtgtgagttgcaagaggggagactactgaataactcaagttttataatcgaggggaaaatggtgatggcgttcatagcaaaacgccctcaaccataaaggtcgagggcgcttaagatgttaaaaacccgctatccgttaaaaaacaatgttcaactaaggtcagtgacattgcgctaaaaaagcgaatt

SEQ ID NO: 44 - DNA, 395 bp, E. Coli
  misc_feature (1)...(395): n = A,T,C or G
gcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgaccctatgtgtttatgaaggagaggtattttcagttgatctggattgntaaattcatataatgcgcctttgctcatgaatggatgccagtatgtagtgggaaattataaatattgaaatagtccaactacttctttattaccaa

SEQ ID NO: 45 - DNA, 883 bp, E. Coli
  misc_feature (1)...(883): n = A,T,C or G
ataatcaggtaagaaaaggtgcgcggagattaccgtgtgttgcgatatattttttagtttcgcgtggcaatacatcagtggcaataaaacgacatatccagaaaaatatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgccgcaggcgnagnntgcncgncgncccacctnaccccatgccgaacttcagaantgaaaacnccntaacnccgatngtcggcgggngcctccccatgcnanagtangggaantgccangcgncnnattaaacgaaaggctnattncaaagactgggccttncntttatctgatgtttgtcggagaacgctctcctgagnangacaaatnccgccgggagcggatttgaacnttgcgaagcaaccgncccnaagggngnngtcntgacncccnnctctanctnncngccttcttttgcttnaangncctcctancngatggcctttttngccntctaccaaacnntttggttaatgcttntaaaancctttccannntncaatccngtnntncccatccnnntnntgaaagnntncctnccntgtncantntanntnngggggnngngngccggcggnccccccccccccccccc

SEQ ID NO: 46 - DNA, 1024 bp, E. Coli
  misc_feature (1)...(1024): n = A,T,C or G
gtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcagagtnctccnantnnnnntnnttntntnnctnnnccttcacnatncnnccncnnantnnatagnncaccnntnttnntcnnnngnccncctccnnncnnnnnnncatnnnatcccactnnntttnctccannnnnncnnnntncanccnacaaantncnaccnanntnaccttatacnnanncnancnnnnnnnnccactctnnctcgnnctccccnttcnacnnccannnnncancnntcnnctnnnnccctnncntaattnttctnnctanntcctanccncnnacnnncccancnatccnnnnatacantcnattnntnncnntcncntncnccnnttccnnctnnncnctnccncatncccnnnannancanntnccccncctncctnaccncncncncccnccatcccnnnccnncntccnnantngacaannnnaatcncnnnnncnnnnnnncnnntnnncncccngcncnnccntnccntcacnctnnncnnctanannnnntacnntnaccnntcctnncacnctnccctnnngantccnacnantnnnnnancnanaacnctntnnnnccataatcccacaccacncccntncancntntnntncntcntcccttcntatcncagctnnnnntnctntnnnnctnccncccnncnnactncnnnnacccncnncccantcagtccaccntccncnncnnnntnnnncnancanctnncacncncnantaacctnntnncaccttccc

SEQ ID NO: 47 - DNA, 236 bp, E. Coli
atatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatat

SEQ ID NO: 48 - DNA, 418 bp, E. Coli
  misc_feature (1)...(418): n = A,T,C or G
cggagattaccgtgtgttgcgatatattttttagtttcgcgtggcaatacatcagtggcaataaaacgacatatccagaaaaatatacactaagtgaatgatatcttccgattnatcttantcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcanggggcggccaatcgccgccggcccctg

SEQ ID NO: 49 - DNA, 550 bp, E. Coli
ctgctagttacagggaacactaatgacagacagctaaaagccctgtttaattacgtattacaaacaggggatgcccagcgttttcgtgcatttattggtgagatagcggaacgcgcaccacaagaaaaggagaaactgatgaccattgctgacagattacgtgaagaaggcgcaatgcagggcaaacacgaagaagccctgcgtattgctcaggagatgctggatagaggtttagacagagagttagttatgatggtgacccgactttcaccagacgatcttatcgcgcaaagccactaatcctgtaacaccgggagttaactggcggatgtttgctgtaaaccacatcagcgaacgacatccgccagcgcctcttctaaatcgtaccagcgaaacgcaaaacccgcttcttccagccgtttaggcagcgcgcgttgtccacctaataccagtactgaagattcgcccattaacagtcgaatggcggtcgcggggacgcgcaaaatggccgggcgatgcagcgcatgaccgagcgcatgggcaaattgtt

SEQ ID NO: 50 - DNA, 99 bp, E. Coli
ttggcatctcggtgttgccgatcttcatgatatccagcccgccggaaacttcttcccaaacggttttgctgttatccattgagtcacggaactgcccct

SEQ ID NO: 51 - DNA, 259 bp, E. Coli
  misc_feature (1)...(259): n = A,T,C or G
ccgtgccgagatgatcctgtnaccatcatccgttgtgaagtagtgattcacgacttcaaggcgcttttcaaaagggtattttggctttgacatattaggggctattccatttcatcgnccaacaaaatgggtgcagtacatactcnttggaaatcaacacaggaggctgggaatgccgcagaaatatagattactttctttaatagtgatntgtttcacgcttttatttttnaaanaagttnggcttacttcccgggnn

SEQ ID NO: 52 - DNA, 877 bp, E. Coli
  misc_feature (1)...(877): n = A,T,C or G
cagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccatgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttggttatttttctaaatcattcaaatatgtatccgntcatcccatcctatcgatgataagctgtcaaacatgagaatttaatcaatctaaagttttatggngttaaacttgggctggcagnttnccaatggcttaatcagtngagggccctatnttaacgaactnggctantttnggtcaatcn

SEQ ID NO: 53 - DNA, 291 bp, E. Coli
tgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggtt

SEQ ID NO: 54 - DNA, 282 bp, E. Coli
ttattaaatgcaaaactaaattattggtatcatgaatttgttgtatgatgaataaaatataggggggtatagatagacgtcattttcatagggttataaatgcgactaccatgaagtttttaattgaaagtattgggttgctgataatttgagctgttctattctttttaaatatctatataggtctgttaatggattttatttttacaattttttgtgtttaggcatataaaaatcaacccgccatatgaacggcgggttaaaatatttacaacttagcaa

SEQ ID NO: 55 - DNA, 293 bp, E. Coli
  misc_feature (1)...(293): n = A,T,C or G
cggggtccggcgctcatcaacaatcggggggcagcaaggggctgaaacgggaaagcccctcccgaagaaggggccttgtataaggaaagggttatgatgaagctcgtcatcatactggttgtgtngttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttg

SEQ ID NO: 56 - DNA, 300 bp, E. Coli
tctgcgttccgctaaaaggtgcaaatgctcaggacgttgcagcgttttgcgtgaccgctcggggaaggcaaaattgcctctgggaaagcattgcgcggggtccggcgctcatcaacaatcggggggcagcaaggggctgaaacgggaaagcccctcccgaagaaggggccttgtataaggaaagggttatgatgaagctcgtcatcatactggttgtgttgttactgttaagtttcccgacttactaacaactcatcagaggggggagaaatcctcccttacccttgttcctttactcta

SEQ ID NO: 57 - DNA, 359 bp, E. Coli
caacacaggaggctgggaatgccgcagaaatatagattactttctttaatagtgatttgtttcacgcttttatttttcacctggatgataagagattcactgtgtgaattgcatattaaacaggagagttatgagctggcggcgtttttagcctgcaaattgaaagagtaagagtcttcggcgggaaattattcccgccttacttacggcgttgcgcattctcattgcacccaaatttattcttcacaaaaataataatagattttattacgcgatcgattatttatttcctgaaaacaaataaaaaaatccccgccaaatggcagggatcttagattctgtgcttttaagcagagatt

SEQ ID NO: 58 - DNA, 700 bp, E. Coli
  misc_feature (1)...(700): n = A,T,C or G
aaacctttttctcctgtttttcatagagggcaacccatgtcctgacctgggttcgggggacaccaaaacgtgccgagatgatcctgtaaccatcatcagttgtgaagtagtgattcacgacttcaaggcgcttttcaaaagggtattttggctttgacatattaggggctattccatttcatcgtccaacaaaatgggtgcagtacatactcgttggaaatcaacacaggaggctgggaatgccgcagaaatatagattactttctttaatagtgatttgtttcacgcttttatttttcacctggatgataagagattcactgtgtgaattgcatattaaacaggagagttatgagctggcggcgtttttagcctgcaaattgaaagagtaagagtcttcggcgggaaattattcccgccttacttacggcgttgcgcattctcattgcacccaaatttattcttcacaaaaataataatagattttattacgcgatcgattatttatttcctgaaaacaaataanaaaatccccgccaaatggcagggatcttagattctgtgcttttaagcagagattacaggctggttacgttaccagctgccgggcctttaacgccgctttcgatggtgaaggacactttctgaccttcgtccagagattgtaaccatcggtctggatagccnagaaatgtccaac

SEQ ID NO: 59 - DNA, 631 bp, E. Coli
  misc_feature (1)...(631): n = A,T,C or G
tggtggcattggttgctggagagagaaaacccccgcacgttgcaggtatgcacctgacaacaccacgggggctaatcttgactctagaccactcaagaatagccgcgaaacgttgtcattacaacacaggcggctatatgacgttcgcagagctgggcatggccttctggcatgatttagcggctccggtcattgctggcattcttgccagtatgatcgtgaactggctgaacaagcggaagtaacgtgtcatgcgggcgtcaggctgccgtaatggcaatttgcgcccggaccaggccgcaggggggaaactctgcggcctttttcgttcttactgcgggtaaggcacccagtcgccgccgttcaggcgaacgtacggtttatcctggtattgaataactactgcatttgagttctcggagaccggtgctgtttgtggcaacccactggtgagttttttccagtcaacattgtcttcggtgaaaatcttgccatcgagaacgcgaaccaccagatcggagatagccaggaagctgctcggttgttcgatgacaatcggtgccccctgatgcggtgccttcatgccgaagaatttcaccccaacggggacgtcngtgatagaccgggctag

SEQ ID NO: 60 - DNA, 648 bp, E. Coli
  misc_feature (1)...(648): n = A,T,C or G
ggctcaggcntgctgattgtttttttgtgcaatggcccngtattagcgtcgttgctgtcgatggagagaatcataaacgtggtgaatgatgattgttagcaaggaaaactgtcaaaaatcttcaaaaaatttgagggataaggccggaatggctccggccagagggaagttaaccgcgaagctgttgctgcttgagggtcgttttaaccagacgccaggcgctccatacgccaaaaccgcgtctggcccagcggaccagcatattaggatggcgaatcgtccagatcgccatcacgctactgccaaccagcgcccaggagcgcagacttagcagcatattccancgacgatcgtaagcgcctgttgtctccagccattcacgacgactggcggaagggnccgcgnctgaccaacttgncttttagnctgatncanattanattnataaacgcagnanncnggtntgattaatcntatttngctctngtctggtagttagcnncggnnngtctcnttntnacccnnttcnntttannttacnatnngtaanttatntttntnngtctnanttntanttgngtactntaagtntatncgnnnatnntnnnannnnncagnncntnttttttaaatnntttntnanncnnc

SEQ ID NO: 61 - DNA, 737 bp, E. Coli
  misc_feature (1)...(737): n = A,T,C or G
tgctaatatctttctcattgagatgaaaattaaggtaagcgaggaaacacaccacaccataaacggaggcaaataatgctgggtaatatgaatgtttttatggccgtactgggaataattttattttctggttttctggccgcgtatttcagccacaaatgggatgactaatgaacggagataatccctcacctaaccggccccttgttacagttgtgtacaaggggcctgatttttatgacggcgaaaaaaaaccgccagtaaaccggcggtgaatgcttgcatggatagatttgtgttttgcttttacgctaacaggcattttcctgcactgataacgaatcgttgacacagtagcatcagttttctcaatgaatgttaaacggagcttaaactcggttaatcacattttgttcgtcaataaacatgcagcgatttcttccggtttgcttaccctcatacattgcccggtccgctcttccaatgaccacatccagaggctcttcaggaaatgcgcgactcacacctgctgtcacggtaatgttgatatgcccttcagaatgtgtgatggcatggttatcgactaactggcaaattctgacacctgcacgacatgcttcttcatcattagccgctttgacaataatgataaattcttcgcccccgtagcgataaaccgtttcgtaatnacgcgtccaactgggntaagtaaagttgccagggtgccgtaatcttac

SEQ ID NO: 62 - DNA, 648 bp, E. Coli
  misc_feature (1)...(648): n = A,T,C or G
tgcttttgaatatgtgctcgcaatcttgagaaggaaatggcgaccacgaaagaaaaggcaaaaaccgataatctgaaagaacccaagtatttcagtataagcattgaatgccgaccagtaaactctttcggattcacccagaaagtgaanccaaaatgataatcgtatacataagtctttcgagtggctcgttagcaaaaagtttcaacaatggagtaaatacatccaacatatcaataactctcaactgtaaggggattgaaatggtaaccccagctcttcgcttgaggggtatagccgagaccaccgaagccccggaggtggtgaaataaaaccgggcacaacacgaaagggcgcatttccgatatccataaaagaagtcgggtctttgtctggtaaaattaaattggtgggaagtgcgcctccgggttgtaaataccgactttgctgggtgtagcctggcggcatcaagtttttttctggaagttcgctgatgtccgccctttttaaagggaattttggtgatgccggtgaatgccgcttaaccccccgtgggcccagttaaaagtcatggtaagncctaatnggtttggggtgggaaaagccnactgnnaattggttacctggtttgcaagtanccctggaagg

SEQ ID NO: 63 - DNA, 237 bp, E. Coli
  misc_feature (1)...(237): n = A,T,C or G
ggtgtttanttacaagagattcatctttgtntaaancccngataagtaattacgcataaaacaacaatgattataatagcaaaaataaatattatcatctttgatagattacttgagatagccagcatcttgtaaagcctttatcgtttttttatgctctggattaatataatcactacatctatctgagcaatctgttgttgatggacatgtcaacccatggtcatttacagccaa

SEQ ID NO: 64 - DNA, 427 bp, E. Coli
gataattagagtttgtcgtcagaaaattgacgttacccataacaaatgaaaggccaggtaaatcatgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcggcgggacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatg

SEQ ID NO: 65 - DNA, 261 bp, E. Coli
  misc_feature (1)...(261): n = A,T,C or G
caaagaaccttcaacatgaaaaatatccatttgtttgcaaaaaaagattattaggaaggaaattaatgcaattatcgaaaattcaaaaaatatccaaaaatngtatactttattccagaagagttcaatataatgtttgtcttcaatttttcttacttcagggtaatatagattgctcattacattgtgagcttcatctttatttaattttctgttgactccagctctccgtgataacggttttataattagatgcttatc

SEQ ID NO: 66 - DNA, 98 bp, E. Coli
agatgattgccgggaacttgttagcggcacgcaggcggcggctcgcacccttaccctgctctttacgtacttctgcgttgatagtaaacatttctttc

SEQ ID NO: 67 - DNA, 260 bp, E. Coli
aagcgcgaacgaagtcgatgtgctgcagcttcggtttgtacgggtgacgctgtacgtcctgagctttaactttgatttctttaccgtcaacaacgatggtcagaacttcgctgtagaattcagctttagcttgcatgttcatgactttgtcgtgatccagctcgatagccagcggcgcttctttgccaccgtagatgattgccgggaacttgttagcggcacgcaggcggcggctcgcacccttaccctgctctttacgt

SEQ ID NO: 68 - DNA, 95 bp, E. Coli
aaaaacggcgtaaagaaaggttgcaaacatgttaataaaaactcaaattgatcccacgtatatattacgccgcaaaatccttacaataaacaggg

SEQ ID NO: 69 - DNA, 174 bp, E. Coli
ttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcg

SEQ ID NO: 70 - DNA, 138 bp, E. Coli
agtctgtaaaaacgtcaaaaagagtgttttatcaacagaagaatggaggtctgacagatagtagtaatgcaaaaaaatggagacttaagttgaatgaacgggagtaaagcgaaaagactatagagtgaaggagaaatt

SEQ ID NO: 71 - DNA, 191 bp, E. Coli
tttgttggcttaatattctattgttatctttatttatagatgtttatattgcatgaggtggtttttggagagaagaatgaggaagatgcgtcgagccacagaaacgttagctttacatatagcggaggtgatgtgaatttaatttacaatagaaataatttacatatcaaacagttagatgctttttgtcg

SEQ ID NO: 72 - DNA, 244 bp, E. Coli
ggccatttatacaggaaaagcctatgtcagaacgtaaaaactcaaaatcacgccgtaattatctcgttaaatgttcctgcccaaactgcacccaagagtcagaacacagtttttcaagagtacaaaaaggtgcccttttgatctgccctcattgcaacaaagtattccagacaaatcttaaagctgtagcctgattgattttattagtaacaagtattttttatattttaataatatatttaaa

SEQ ID NO: 73 - DNA, 327 bp, E. Coli
  misc_feature (1)...(327): n = A,T,C or G
aaattttcaggtaccttgtcaccatacttttttttctgagcattaatgatattttgagcttcttgaggatctttaactccccacatttggtggaaagtattcatattaaaaggaaggntgaataatttgnctttataaatcgccagtggagaattagtaaaacgattaaattctactaaatnattaaccgnaaaaaaattcccatatatatttatcattggtatgaaaaatatgtgcaccatatttatgaatntggataccctnacagtcctctgtgtacgcatttccaccgatatgatttcttttctnaatcactaaaactttttt

SEQ ID NO: 74 - DNA, 150 bp, E. Coli
gcagtgatcgaagcgatgacgaagtgtatggaaaaatcagaaaaactcagcaaatcctgatgactttcgccggacgtcaggccgccacttcggtgcggttacgtccggctttctttgctttgtaaagcgccaaatctgccgatttcaacc

SEQ ID NO: 75 - DNA, 330 bp, E. Coli
gaaagtatcttcgttattgacatcactggaaaatataacttgcttttcattattaaactcgaagcgcgtaccgtatctggacaaacatttatcgagcttaccaaattcctgaagaggtttaactacagataacatttgcgcgtcctttgcagtaatgcccgtcaaatccttgacgggcattatttagattaaattaccagtatttcttcggagtgaagaatattaccaggtatatttaacacccacgttcgcggaccagtcttgatctacgtcaccaccaccgaggtagttagcatcggtataggcgctgaagttcttggtgaagctaaa

SEQ ID NO: 76 - DNA, 194 bp, E. Coli
tgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttcc

SEQ ID NO: 77 - DNA, 188 bp, E. Coli
tccctttaactaccagggtgttaacgacttcgacttcgacttcaaacagtttctgcacagcagctttgatttctgctttggtcgcgtctttagcaactttgagtactatggtgttggatttttccatcgcagtagacgctttttcagaaacgtgcggtgcacgcagcaccttcagcagacgttcttca

SEQ ID NO: 78 - DNA, 173 bp, E. Coli
acaaaggcgaacaaagcctgtgaagcccgaaggctccacagacagtgctacttgaaggccttactgtttcttcttaggagcgagcaccatgatcatctggcggccttcgatcttggttgggaaggattcgaccactgccagttcttgcaaatcgtctttcacgcgattaagca

SEQ ID NO: 79 - DNA, 272 bp, E. Coli
  misc_feature (1)...(272): n = A,T,C or G
tggagaaaacgggtgattgataaagcaatcatcgttctaggggcgttaattgcgctgctggaactgatcccgctttctgcttcaagcttctgaactggatacggaaacgtaatnagggctaaagaagacactactcttagccctttaacatttaacgcattgtcacgaactcttctgccgccgttgggtgaatggcgacgggtattggtcgaaatcttttttgggtggccccatctttaacgcccacccgcgaaaccctgcaacatttcgtc

SEQ ID NO: 80 - DNA, 259 bp, E. Coli
cgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtc

SEQ ID NO: 81 - DNA, 73 bp, E. Coli
caggtcggaacttacccgacaaggaatttcgctaccttaggaccgttatagttacggccgccgtttaccgggg

SEQ ID NO: 82 - DNA, 666 bp, E. Coli
atgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaa

SEQ ID NO: 83 - DNA, 612 bp, E. Coli
gtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaa

SEQ ID NO: 84 - DNA, 975 bp, E. Coli
atggcgaatatgtttgccctgattctggtgattgccacactggtgacgggcattttatggtgcgtggataaattctttttcgcacctaaacggcgggaacgtcaggcagcggcgcaggcggctgccggggactcactggataaagcaacgttgaaaaaggttgcgccgaagcctggctggctggaaaccggtgcttctgtttttccggtactggctatcgtattgattgtgcgttcgtttatttatgaaccgttccagatcccgtcaggttcgatgatgccgactctgttaattggtgattttattctggtagagaagtttgcttatggcattaaagatcctatctaccagaaaacgctgatcgaaaccggtcatccgaaacgcggcgatatcgtggtctttaaatatccggaagatccaaagcttgattacatcaagcgcgcggtgggtttaccgggcgataaagtcacttacgatccggtctcaaaagagctgacgattcaaccgggatgcagttccggccaggcgtgtgaaaacgcgctgccggtcacctactcaaacgtggaaccgagcgatttcgttcagaccttctcacgccgtaatggtggggaagcgaccagcggattctttgaagtgccgaaaaacgaaaccaaagaaaatggaattcgtctttccgagcgtaaagagacactgggtgatgtgacgcaccgcattctgacagtgccgattgcgcaggatcaggtggggatgtattaccagcagccagggcaacaactggcaacctggattgttcctccgggacaatacttcatgatgggcgacaaccgcgacaacagcgcggacagccgttactggggctttgtgccggaagcgaatctggtcggtcgggcaacggctatctggatgagcttcgataagcaagaaggcgaatggccgactggtctgcgcttaagtcgcattggcggcatccattaa

SEQ ID NO: 85 - DNA, 1761 bp, E. Coli
ttgaccattacgaaacttgcatggcgtgacctggttcctgataccgatagctatcaggaaatatttgctcagccacatttgattgacgaaaacgatcctttattcagtgatactcaaccgcggctgcaatttgcgctggagcagttgctgcatacgcgagcatcctcctcttttatgctggcgaaggccccggaagagtctgagtatctgaatcttattgccaatgccgcgcgtacgctacaaagcgatgcaggccaactggtgggcggtcactatgaggtttccggccactccatccgcttacgtcacgcagtgagtgcagatgataattttgcgactttaacgcaagttgtcgctgccgactgggtagaagcggagcaactctttggctgcctgcgccagtttaatggcgacattaccctgcagcctggtctggtgcatcaggcaaatggcggtattctcattatctctttgcgtacactgctggcgcaacctctgctgtggatgcggctgaaaaatatcgttaaccgcgagcgttttgactgggttgcgtttgatgagtcgcgccctctccccgtctctgtgccttcgatgccattgaagctgaaagtcattctggtaggcgaacgcgaatcattggctgatttccaggagatggagccagagctttcagagcaggctatttatagcgaatttgaagatactctgcagattgtcgatgcggagtcagtaacccagtggtgtcgctgggtgacatttaccgccagacataatcacttacctgcaccgggagcggatgcctggccgatacttatccgcgaagcagcacgctacaccggtgaacaagaaacacttccgcttagcccgcagtggatcctccgccagtgtaaagaggtcgcctccctgtgtgatggcgacaccttctccggcgagcagctaaacttaatgctgcagcagcgtgaatggcgcgaaggtttcctcgctgaacgtatgcaggatgagatccttcaggagcaaatcctgattgaaaccgaaggcgaacgcatcgggcaaattaacgccctttcggtcattgaatttccgggtcatccacgcgcttttggcgaaccttctcgcattagctgcgttgtgcatattggcgatggtgaattcaccgacatcgaacgcaaagcggagcttggcggcaatatccatgcgaaagggatgatgatcatgcaagcgttcctgatgtcggaactacagcttgagcaacagatccccttctcagcatcgctgacatttgagcagtcatacagtgaagttgatggagatagtgcctcgatggctgaactctgcgccctgataagcgccctcgccgatgtgccggtgaatcagagtatcgctatcacaggttcagtcgatcagttcggtcgcgcccagccggtcggtggtttaaatgagaaaatcgaaggcttctttgctatttgccagcaacgtgagttaaccgggaaacaaggtgtcattatccccacagctaacgttcgccatttaagtcttcacagtgaactggtgaaagcggtagaagaaggcaaattcaccatctgggcagtagacgatgtgactgacgcactgccgttattattaaatctggtgtgggatggcgaaggccaaacgacgctgatgcaaaccatccaggaacgtatcgcgcaagcatcgcaacaggaaggacgtcaccgttttccatggccattacgttggctgaactggtttattccgaactga

SEQ ID NO: 86 - DNA, 1185 bp, E. Coli
gtgtctaaagaaaaatttgaacgtacaaaaccgcacgttaacgttggtactatcggccacgttgaccacggtaaaactactctgaccgctgcaatcaccaccgtactggctaaaacctacggcggtgctgctcgtgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgctcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttatattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgttgctaaagttctgggctaa

SEQ ID NO: 87 - DNA, 2115 bp, E. Coli
atggctcgtacaacacccatcgcacgctaccgtaacatcggtatcagtgcgcacatcgacgccggtaaaaccactactaccgaacgtattctgttctacaccggtgtaaaccataaaatcggtgaagttcatgacggcgctgcaaccatggactggatggagcaggagcaggaacgtggtattaccatcacttccgctgcgactactgcattctggtctggtatggctaagcagtatgagccgcatcgcatcaacatcatcgacaccccggggcacgttgacttcacaatcgaagtagaacgttccatgcgtgttctcgatggtgcggtaatggtttactgcgcagttggtggtgttcagccgcagtctgaaaccgtatggcgtcaggcaaacaaatataaagttccgcgcattgcgttcgttaacaaaatggaccgcatgggtgcgaacttcctgaaagttgttaaccagatcaaaacccgtctgggcgcgaacccggttccgctgcagctggcgattggtgctgaagaacatttcaccggtgttgttgacctggtgaaaatgaaagctatcaactggaacgacgctgaccagggcgtaaccttcgaatacgaagatatcccggcagacatggttgaactggctaacgaatggcaccagaacctgatcgaatccgcagctgaagcttctgaagagctgatggaaaaatacctgggtggtgaagaactgactgaagcagaaatcaaaggtgctctgcgtcagcgcgttctgaacaacgaaatcatcctggtaacctgtggttctgcgttcaagaacaaaggtgttcaggcgatgctggatgcggtaattgattacctgccatccccggttgacgtacctgcgatcaacggtatcctggacgacggtaaagacactccggctgaacgtcacgcaagtgatgacgagccgttctctgcactggcgttcaaaatcgctaccgacccgtttgttggtaacctgaccttcttccgtgtttactccggtgtggttaactctggtgataccgtactgaactccgtgaaagctgcacgtgagcgtttcggtcgtatcgttcagatgcacgctaacaaacgtgaagagatcaaagaagttcgcgcgggcgacatcgctgctgctatcggtctgaaagacgtaaccactggtgacaccctgtgtgacccggatgcgccgatcattctggaacgtatggaattccctgagccggtaatctccatcgcagttgaaccgaaaaccaaagctgaccaggaaaaaatgggtctggctctgggccgtctggctaaagaagacccgtctttccgtgtatggactgacgaagaatctaaccagaccatcatcgcgggtatgggcgaactgcacctcgacatcatcgttgaccgtatgaagcgtgaattcaacgttgaagcgaacgtaggtaaaccgcaggttgcttaccgtgaaactatccgccagaaagttaccgatgttgaaggtaaacacgcgaaacagtctggtggtcgtggtcagtatggtcatgttgttatcgacatgtacccgctggagccgggttcaaacccgaaaggctacgagttcatcaacgacattaaaggtggtgtaatccctggcgaatacatcccggccgttgataaaggtatccaggaacagctgaaagcaggtccgctggcaggctacccggtagtagacatgggtattcgtctgcacttcggttcttaccatgacgttgactcctctgaactggcgtttaaactggctgcttctatcgcctttaaagaaggctttaagaaagcgaaaccagttctgcttgagccgatcatgaaggttgaagtagaaactccggaagagaacaccggtgacgttatcggtgacttgagccgtcgtcgtggtatgctcaaaggtcaggaatctgaagttactggcgttaagatccacgctgaagtaccgctgtctgaaatgttcggatacgcaactcagctgcgttctctgaccaaaggtcgtgcatcatacactatggaattcctgaagtatgatgaagcgccgagtaacgttgctcaggccgtaattgaagcccgtggtaaataa

SEQ ID NO: 88 - DNA, 540 bp, E. Coli
atgccacgtcgtcgcgtcattggtcagcgtaaaattctgccggatccgaagttcggatcagaactgctggctaaatttgtaaatatcctgatggtagatggtaaaaaatctactgctgaatctatcgtatacagcgcgctggagaccctggctcagcgctctggtaaatctgaactggaagcattcgaagtagctctcgaaaacgtgcgcccgactgtagaagttaagtctcgccgcgttggtggttctacttatcaggtaccagttgaagtccgtccggttcgtcgtaatgctctggcaatgcgttggatcgttgaagctgctcgtaaacgcggtgataaatccatggctctgcgcctggcgaacgaactttctgatgctgcagaaaacaaaggtactgcagttaagaaacgtgaagacgttcaccgtatggccgaagccaacaaggcgttcgcacactaccgttggttatcccttcggagttttagtcaccaggcgggcgcttccagtaagcagcccgctttgggctacttaaattga

SEQ ID NO: 89 - DNA, 1549 bp, E. Coli
aaattgaagagtttgatcatggctcagattgaacgctggcggcaggcctaacacatgcaagtcgaacggtaacaggaagcagcttgctgcttcgctgacgagtggcggacgggtgagtaatgtctgggaagctgcctgatggagggggataactactggaaacggtagctaataccgcataatgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcgggttggttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaa

SEQ ID NO: 90 - DNA, 375 bp, E. Coli
atggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcgctgcgtaaagtatgccgtgttcgtctgactaacggtttcgaagtgacttcctacatcggtggtgaaggtcacaacctgcaggagcactccgtgatcctgatccgtggcggtcgtgttaaagacctcccgggtgttcgttaccacaccgtacgtggtgcgcttgactgctccggcgttaaagaccgtaagcaggctcgttccaagtatggcgtgaagcgtcctaaggcttaa

SEQ ID NO: 91 - DNA, 366 bp, E. Coli
atgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgcaccggctgctctgaaagaaggcgtgagcaaagacgacgcagaagcactgaaaaaagctctggaagaagctggcgctgaagttgaagttaaataa

SEQ ID NO: 92 - DNA, 498 bp, E. Coli
atggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaa

SEQ ID NO: 93 - DNA, 2145 bp, E. Coli
gtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaa

SEQ ID NO: 94 - DNA, 1767 bp, E. Coli
atgaataattctattaaccataaatttcatcacattagccgggctgaataccaggaattgttagccgtttcccgtggcgacgctgttgccgattatattattgataatgtctctattctcgacctgatcaatggcggagaaatttccggcccaattgtgattaaaggacgttacattgccggtgttggcgcagaatacactgatgctccggctttgcagcggattgatgctcgcggcgcaacggcggtgccagggtttattgatgctcacctgcatattgaatccagcatgatgacgccggtcacttttgaaaccgctaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgccctggaaggctgcgatgttaacggtgccagttttacccttgaacagatgctcgcctggcgggaccatccgcaggttaccggccttgcagaaatgatggactaccctggcgtaattagcgggcagaatgcgctgctcgataaactggatgcatttcgccacctgacgctggacggtcactgcccgggtttgggtggtaaagaacttaacgcctatattactgcgggtattgaaaactgccacgaaagttatcagctggaagaaggacgccggaaattacaactcggcatgtcgttgatgatccgcgaagggtccgctgcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtgccgctgcatgtggcatatcgcgtcgccagctggtcgacggcgcgccactttggtctgaatcacctcggcttactggcacccggcaagcaggccgatatcgtcctgttgagcgatgcgcgtaaggtcacggtgcagcaggtactggtgaaaggcgagccgattgatgcgcaaaccttacaggcggaagagtcggcgagactggcacaatccgctccgccatatggcaacaccattgcccgccagccagtttccgccagcgactttgccctgcaatttacgcccggaaaacgctatcgggtcattgacgtcatccataacgaattgattacgcactcccactccagcgtctacagcgaaaatggttttgatcgcgatgatgtgagctttattgccgtacttgagcgttacgggcaacggctggctccggcttgtggtttgcttggcggctttggactgaatgaaggtgcgctggctgcgacggtcagccatgacagccataatattgtggtgatcggtcgcagtgccgaagagatggcgctggcggtcaatcaggtgattcaggatggcggcgggctgtgcgtggtacgtaacggccaggtacaaagtcatctgccgttacccattgccgggctgatgagcaccgacacggcgcagtcgctggcggaacaaattgacgccttgaaagccgccgcccgtgaatgcggtccgttacccgatgagccgtttattcagatggcgtttctttctctgccagtgatccccgcgctaaaactaaccagtcaggggctatttgatggcgagaagtttgccttcactacgctggaagtcacggaataa

SEQ ID NO: 95 - DNA, 1227 bp, E. Coli
atggcgtattgcaatccgggcctggaatccaggccgaataagagaaacgccctccggcgtcatgtggtaacaggcataggtatgaaaatcgtaatcgccccagactcttataaagaaagtttatctgccagcgaggttgcgcaggcgatagaaaaaggatttcgggaaatttttcctgatgcacagtacgtttctgttccggttgccgacggtggcgaaggaacggtggaagcgatgattgcagccacccagggggctgaacgtcacgcctgggttacagggccgctgggcgagaaagtgaatgccagttgggggatctccggcgatggcaaaaccgcgtttattgaaatggcggcggccagtgggctggagctggtacctgcggaaaaacgcgatccactcgtgaccacttcacgcggcacaggcgagttaatcctgcaggcgctggagagcggtgcgacaaacattattatcggcattggcggcagcgctacaaatgatggcggcgcaggcatggtacaggcgctgggggcgaaattatgcgacgccaacggcaatgaaattggttttggcggcggtagtcttaatactctgaatgatattgatatttccggcctcgatccgcgcttaaaagattgcgtcattcgcgtcgcttgtgatgtcaccaatccgctggtgggcgataacggcgcatcgcgcatctttggcccacaaaagggagccagtgaagcgatgattgttgagctggacaataacctctctcactatgccgaggtcattaaaaaagcgctgcatgttgatgtgaaagatgtccccggtgcaggagctgcgggtggtatgggcgcggcgctaatggcgtttcttggtgcggaactgaaaagtggtattgaaatcgtcactacggcgctgaatctggaggaacatattcacgattgtacgctggtgatcaccggtgaagggcgtattgacagccagagtattcacgggaaggtaccgattggtgtcgcaaacgtggcgaagaagtaccataaaccggtgattggcattgcgggtagcctgaccgatgatgttggcgttgtacatcagcatggcattgatgcggtcttcagcgtattgaccagcataggtacgttggacgaagcattccgcggggcttatgacaatatctgccgtgcttcacgtaatatcgccgcgacactggcgattggaatgcgcaacgcggggtga

SEQ ID NO: 96 - DNA, 900 bp, E. Coli
atgattgatatgactatgaaagttggttttattggcctggggattatgggtaaaccaatgagtaaaaaccttctgaaagcaggttactcgctggtggttgctgaccgtaacccagaagctattgctgacgtgattgctgcaggtgcagaaacagcgtctacggctaaagcgatcgctgaacagtgcgacgtcatcataaccatgctgccaaactcccctcatgtgaaagaggtggcgctgggtgagaatggcattattgaaggcgcgaagccaggtacggtattgatcgatatgagttctatcgcaccgctggcaagccgtgaaatcagcgaagcgctgaaagcgaaaggcattgatatgctggatgctccggtgagcggcggtgaaccgaaagccatcgacggtacgctgtcagtgatggtgggcggcgacaaggctattttcgacaaatactatgatttgatgaaagcgatggcgggttccgtggtgcataccggggaaatcggtgcaggtaacgtcaccaaactggcaaatcaggtcattgtggcgctgaatattgccgcgatgtcagaagcgttaacgctggcaactaaagcgggcgttaacccggacctggtttatcaggcaattcgcggtggactggcgggcagtaccgtgctggatgccaaagcgccgatggtgatggaccgcaacttcaagccgggcttccgtattgatctgcatattaaggatctggcgaatgcgctggatacttctcacggcgtcggcgcacaactgccgctcacagctgcggttatggagatgatgcaggcactgcgagcagatggtttaggaacggcggatcatagcgccctggcgtgctactacgaaaaactggcgaaagtcgaagttactcgttaa

SEQ ID NO: 97 - DNA, 771 bp, E. Coli
atgaataacgatgttttcccgaataaattcaaagccgcactggctgcgaaacaggtacaaattggttgctggtcagcactctctaacccgattagcactgaagttcttggtttggctgggtttgactggctggtgctggatggcgaacatgcgccaaacgatatctccacgtttattccgcagttaatggccttgaaaggcagcgccagcgcgccagtagtgcgagtgccgaccaacgagccggtaattattaagcgtcttctggatatcggtttctataacttcctgattccttttgtagaaacaaaagaggaagcagagctggcggtggcatcaacccgttacccaccggaaggcattcgcggcgtctccgtttctcaccgcgccaatatgtttggcaccgtggcggattatttcgctcagtcgaacaagaacatcactattctggtccagatagaaagtcagcagggcgtagataacgtcgatgccattgccgctaccgaaggcgtagacggcatcttcgtcggccccagcgatctggccgcggcattaggccatctcggcaatgcatcacacccggatgtacaaaaagcaattcagcacatttttaaccgtgccagcgcgcacggcaaacccagcggtatcctcgcgccggtcgaagccgatgcgcgtcgttatctggaatggggcgcgacgtttgtggctgtcggcagcgatctcggcgtcttccgctctgccactcagaaactggctgatacctttaaaaaataa

SEQ ID NO: 98 - DNA, 1335 bp, E. Coli
atgattctggacaccgttgacgaaaaaaagaaaggcgtgcatacccgctatttaatattactgattatttttattgttaccgccgttaactacgccgatcgtgcaacgctgtctattgctggtaccgaagtggcaaaagagttgcagttaagtgcggtttcgatgggttacatcttctccgcttttggctgggcctacttgctgatgcaaatccccggcggctggctgcttgataagtttggctcgaaaaaagtttacacctacagcctctttttctggtcgctattcaccttcctgcaaggctttgttgatatgttcccgctggcctgggcagggatctccatgttctttatgcgctttatgctcggcttctcggaagcgccatcattcccggcgaacgcccgaattgtcgccgcctggttcccgacgaaagaacgtggtactgcctccgccatctttaactcggcgcaatatttctcgctggcgctcttttcgccgctgcttggctggctgactttcgcctggggctgggagcacgtctttaccgttatgggggtgattggttttgtgctgacggcgctgtggatcaagttgattcataacccgacagatcacccacgtatgtctgcggaagagctgaagtttatctctgaaaatggcgcggtggtcgatatggaccacaaaaagccgggcagtgcggcagcaagcggacccaaactgcattacatcaagcaattgctctctaaccgcatgatgctgggcgtatttttcggacaatattttatcaacaccatcacctggttcttcctcacctggttcccgatttatctggtgcaggaaaaaggcatgtcgattctgaaagtgggtctggtcgcctcgattccagcactgtgtggttttgcgggcggcgtgctgggaggtgtcttctcggattatctgatcaaacgcggtttatccctgaccctggcacgtaagctaccgattgtgctgggaatgttgctggcttccaccatcatcttatgtaactacaccaacaacaccacgctggtggtcatgctgatggcgctggctttctttggcaaaggatttggtgcgctgggctggccggtgatttctgacaccgcgccgaaagagattgttggcctctgcggcggcgtctttaacgtctttggcaatgttgcctccattgtcactccactggtgattggctacctggtaagtgaactgcactccttcaatgcagcactggttttcgtgggatgttcagcgctgatggcgatggtctgctacctcttcgtagttggcgacattaaacgtatggaattgcagaaataa

SEQ ID NO: 99 - DNA, 1536 bp, E. Coli
atgcaaacgagtgatacccgcgcgttaccgctactttgcgcccgctcggtttataaacagtattcaggggtcaatgtcctgaaaggcatcgattttacgttgcatcagggggaggtccacgccctgctcggcggcaatggtgccggtaaatcgacgttaatgaagattattgccggtattacccctgctgatagcggtacgctggagattgagggcaacaactacgtcagattaacgccagttcatgctcatcagctgggtatttatctcgttccccaggaaccgctgcttttcccaagcctgtcgataaaagaaaacatcctgtttgggctggcaaaaaaacagctctccatgcagaaaatgaagaacttgctggcggcgctgggctgccagtttgatctgcatagtctggcaggatcgctggatgtcgccgatcgccaaatggtggaaatcctccgcgggctgatgcgcgactcgcggattctgatcctcgatgaacctaccgcctcgcttacccctgcggaaaccgaacgcttgtttagtcgcttgcaagagctgcttgctactggcgtgggtattgtttttatctcgcataagctgccggaaattcgccagattgccgatcgaattagcgtgatgcgcgacggaaccatcgccttaagcggcaaaaccagcgaactgtctaccgacgacattattcaggccatcaccccagcggtacgggaaaaatcgctctctgccagccaaaaattatggctggagttacctggtaaccgcccacaacatgccgccggaacgccggtgctgacactggaaaatctgaccggcgaaggtttcaggaatgtcagcctgacgctcaatgccggagaaattctgggcctggctgggctggtgggggccggacgcacagaactggccgagacgctctatggtctgcgtactttgcgtggcggacgcattatgctgaatggtaaagagatcaataaattatccactggagaacgtttactgcgcggtctggtttatctgccggaagatcgccagtcatccggactgaatctcgatgcttcgctggcctggaacgtctgcgcccttactcataaccttcgtggattctgggcgaaaaccgcgaaagataatgccaccctggaacgttatcgtcgggcgctgaatattaaattcaaccaaccggaacaagctgcacggacattatccggtggcaaccagcaaaaaatcctcattgccaaatgcttggaagcttcgccgcaagtattgattgtcgatgagccgacgcgcggcgtggatgtctcggcccgtaatgatatctaccagctgttgcgcagcatcgccgcacaaaatgtggctgtgctgcttatctcctccgacctggaagagatcgaactgatggcagatcgtgtgtatgtgatgcatcagggcgaaattacccactctgcactgaccgagcgcgatattaatgtcgagactattatgcgcgttgccttcggcgatagtcagcgtcaggaggcgtcatgctga

SEQ ID NO: 100 - DNA, 1029 bp, E. Coli
atgctgaagtttattcagaacaaccgtgaaatcacggcactgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcttgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggcaaatggattgaagggttacccgccgaactgaaacagctctccgccccgctgctgcttggcgtttcagcaattggttggttgacgataattctggtggcatttatggcctggctgctggcaaagacggcgtttggacgcagtttttatgccacgggcgataatttacagggcgctcgtcaactgggcgttcgtactgaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggtggttccggtgcgatcattggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataa

SEQ ID NO: 101 - DNA, 993 bp, E. Coli
atgcgtattcgctacggttgggaactggctcttgccgcactgctcgttattgagattgtcgcatttggtgcaattaacccgcgaatgttagatctcaatatgttgctgttcagcaccagtgactttatctgcattggcattgtcgccctaccgctaacgatggtgattgtcagtggcgggatcgatatttcgtttggttcgaccatcggcctctgcgccattgcattgggcgtactgtttcaaagtggtgtgccgatgccgctggcgatactcctgaccttactgctcggcgcattgtgcgggctgatcaacgccggattaattatctataccaaagttaacccgctggtgattacgcttggcacgctgtatctgtttgccggaagcgctctgctgctttccggtatggccggagcgacggggtacgaaggtattggtggattcccgatggcgtttacagatttcgctaacctggatgtgctgggactccccgttccgctgattatcttcctgatatgtctcctcgttttctggctctggctgcataaaacccatgccggacgtaatgtgtttttgattgggcaaagcccgcgcgtggcgctttatagcgcgattccagttaaccgtaccttatgtgcgctctatgccatgacggggctggcgtctgcggtcgccgctgtgctgctggtatcgtattttggttcagcacgttccgatctcggtgcgtcgtttctgatgcccgccatcaccgccgtggtgcttggcggggccaatatttatggtggttccggttccattatcggcaccgccattgcggttttattagtgggatatttgcaacaaggtttgcaaatggcaggagtgccaaatcaggtgtccagcgccctttccggtgcgctacttatcgtcgttgtcgtaggtcgttccgttagcctgcatcgccagcaaattaaagagtggctggcgcgtcgggccaataacccattgccataa

SEQ ID NO: 102 - DNA, 1023 bp, E. Coli
atgacacttcatcgctttaagaaaatcgccttacttagcgctcttggcattgccgcaatctctatgaatgtgcaggccgcagagcgtattgcatttattcccaaactggttggcgtgggattttttaccagcggtggcaacggcgcacaacaagcgggtaaagagctgggcgttgatgtgacctacgacgggccgacagaacccagtgtttctggtcaggtacagttgattaataacttcgtcaatcaaggttataacgccattatcgtttctgcggtttcgcctgatggcttgtgtccggcactgaaacgcgccatgcaacgtggtgtgagagtgctgacctgggactctgatactaaaccggagtgccgctcttactacattaatcagggaacgcccgcccagttaggaggtatgttggtggatatggcggcgcgtcaggtgaataaagacaaagccaaagtcgcgtttttctactcaagccccaccgttacggaccaaaaccagtgggtgaaagaagcgaaagcgaaaatcgccaaagagcatccaggctgggaaattgtcactacgcagtttggctataacgatgccactaaatcgttacaaaccgcagaaggaatattaaaagcgtatagcgatctcgacgccattatcgcccccgatgccaacgccctgcccgctgccgcacaagccgcagaaaacttgaaaaatgacaaagtagcgattgtcggattcagtacgccaaatgtgatgcgcccgtatgtagagcgcggcacggtgaaagaatttggcctgtgggatgtggttcagcaaggcaaaatttcagtgtatgtcgcggatgcattattgaaaaaaggatcaatgaaaacgggcgacaagctggatatcaagggcgtaggtcaggttgaagtctcgccaaacagcgttcagggctatgactacgaagcggatggtaatggcatcgtactgttaccggagcgcgtgatattcaacaaagagaatatcggcaaatacgatttctga

SEQ ID NO: 103 - DNA, 876 bp, E. Coli
atggcagatttagacgatattaaagatggtaaagattttcgtaccgatcaaccgcaaaaaaatatcccttttaccctgaaaggttgcggtgcgctggattggggaatgcagtcacgcttatcgcggatatttaatccgaaaacgggtaaaaccgtgatgctggcttttgaccatggttattttcagggaccgactaccggacttgaacgcattgatataaatatcgccccgctgtttgaacatgccgatgtattaatgtgtacgcgcggcattttgcgcagcgtagttccccctgcgaccaataggccggtggtactgcgggcgtcaggtgcgaactctattctggcggaattaagtaatgaagccgtggcgttatcgatggatgacgccgtgcgcctgaacagttgcgcggtggcggcgcaggtttatatcggcagcgaatatgaacatcagtcgatcaaaaatattattcagctggttgatgccggaatgaaagtgggaatgccgaccatggccgtgactggcgtgggcaaagatatggtgcgcgatcagcgttatttctcgctcgcgactcgaatcgccgctgaaatgggggcgcaaattatcaaaacctattatgtcgaaaaaggttttgaacggattgttgccggatgtccggtacccattgttattgctggcggtaaaaaattaccggagcgcgaggcgctggaaatgtgctggcaggctatcgatcagggcgcttctggtgtggatatggggcgtaatattttccagtctgaccatccggtggcgatgatgaaagccgtacaggcggtggttcaccataacgaaacggctgatcgggcatatgaactctatctgagtgaaaaacagtaa

SEQ ID NO: 104 - DNA, 291 bp, E. Coli
atgcacgtcacactggttgaaattaacgttcatgaagacaaggttgacgagtttatcgaagtttttcgccagaaccacctgggctctgtacaggaagaaggcaatttgcgcttcgatgtcttacaggacccggaagtgaattcgcgcttttatatctacgaagcctataaagatgaagacgcagtggcgttccataaaaccacgccccactacaaaacctgtgtcgcgaaactggaatctttaatgaccgggccgcgtaaaaaacgtctgttcaatggtttgatgccgtga

SEQ ID NO: 105 - DNA, 1152 bp, E. Coli
atgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaa

SEQ ID NO: 106 - DNA, 3048 bp, E. Coli
atggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaacatctgcggtacgccaaaagccgacttcctgaaagtgtgtgaagtgctggcctccaccagcgcaccggatcgcacaaccaccttcctgtacgcgctgggctggacgcagcacactgtgggtgcgcagaacatccgtactatggcgatgatccagttgctgctcggtaacatgggtatggccggtggcggcgtgaacgcattgcgtggtcactccaacattcagggcttgactgacttaggcctgctctctaccagcctgccaggttatctgacgctgccgtcagaaaaacaggttgatttgcagtcgtatctggaagcgaacacgccgaaagcgacgctggctgatcaggtgaactactggagcaactatccgaagttcttcgttagcctgatgaaatctttctatggcgatgccgcgcagaaagagaacaactggggctatgactggctgccgaagtgggaccagacctacgacgtcatcaagtatttcaacatgatggatgaaggcaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggtgagtcgaacgatgtcgatccggcgtctattcagactgaagtattccgtctgccttcgacctgctttgctgaagaagatggttctatcgctaactccggtcgctggttgcagtggcactggaaaggtcaggacgcgccgggcgaagcgcgtaacgacggtgaaattctggcgggtatctaccatcatctgcgcgagctgtaccagtccgaaggtggtaaaggcgtagaaccgctgatgaagatgagctggaactacaagcagccgcacgaaccgcaatctgacgaagtggctaaagagaacaacggctacgcgctggaagatctctatgacgctaatggcgtgcttattgcgaagaaaggtcagttgctgagtagctttgcgcatctgcgtgatgacggtacaaccgcatcttcttgctggatctacaccggtagctggacagagcagggcaaccagatggctaaccgcgataactccgacccgtccggtctggggaatacgctgggatgggcctgggcgtggccgctcaaccgtcgcgtgctgtacaaccgtgcttcggcggatatcaacggtaaaccgtgggatccgaaacggatgctgatccagtggaacggcagcaagtggacgggtaacgatattcctgacttcggcaatgccgcaccgggtacgccaaccgggccgtttatcatgcagccggaagggatgggacgcctgtttgccatcaacaaaatggcggaaggtccgttcccggaacactacgagccgattgaaacgccgctgggcactaacccgctgcatccgaacgtggtgtctaacccggttgttcgtctgtatgaacaagacgcgctgcggatgggtaaaaaagagcagttcccgtatgtgggtacgacctatcgtctgaccgagcacttccacacctggaccaagcacgcattgctcaacgcaattgctcagccggaacagtttgtggaaatcagcgaaacgctggcggcggcgaaaggcattaataatggcgatcgtgtcactgtctccagcaagcgtggctttatccgcgcggtggctgtggtaacgcgtcgtctgaaaccgctgaatgtaaatggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaa

SEQ ID NO: 107 - DNA, 885 bp, E. Coli
atggctatggaaacgcaggacattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatcccggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgccgggttgattttccactacatcggtattggcccgaataaggaagtggacgatgacgaggaggatcatcatgagtaa

SEQ ID NO: 108 - DNA, 654 bp, E. Coli
atgagtaagtcgaaaatgattgtgcgcaccaaatttattgatcgcgcctgtcactggaccgtggtgatttgcttcttcctggtggcgctgtccgggatttcgttcttcttcccgacgctgcaatggctgacgcaaaccttcggtacgccgcagatgggacgcattttgcacccgttcttcggcattgcgattttcgtcgcactgatgtttatgtttgtgcgttttgtgcatcacaacatcccggataagaaagatattccgtggctgttgaacattgtcgaagtattgaaaggcaatgagcataaagtggcggatgtcggtaagtacaacgccgggcaaaagatgatgttctggtcgatcatgagcatgattttcgtgctgctggtgaccggggtgattatctggcgtccgtactttgcgcagtacttcccgatgcaggttgttcgctacagcctgctgatccacgcggctgcgggtatcatcctgatccacgccatcctgatccatatgtatatggcattttgggtgaaaggatcgattaaagggatgatcgaagggaaggtaagtcgtcgctgggcgaagaaacaccatccgcgctggtatcgtgaaatcgagaaggcagaagcgaaaaaagagagtgaagaagggatataa

SEQ ID NO: 109 - DNA, 261 bp, E. Coli
atggcgttgttaatcactaaaaaatgcatcaattgtgatatgtgtgaacccgaatgcccgaatgaggcgatttcaatgggagatcatatctacgagattaacagcgataagtgtaccgaatgcgtagggcactacgagacaccaacctgccagaaggtgtgcccgatccccaatactattgtgaaagatccggcgcatgtcgagacagaagaacagttgtgggataaatttgtgctgatgcaccacgcggataaaatttaa

SEQ ID NO: 110 - DNA, 1203 bp, E. Coli
atgcaaagtgttgatgtagccattgttggcggcggcatggtggggctggcggttgcctgtggcttacaggggagcggcttacgcgttgccgtactggagcagcgcgtacaggaacctctggcggcgaatgcaccaccacaactgcgcgtttcggctatcaatgccgccagcgaaaaattactcacccgtcttggcgtctggcaggacattctctctcgtagggccagctgttatcacggtatggaagtgtgggacaaagacagctttggtcacatttcgtttgacgatcaaagcatgggctatagccatcttgggcatatcgttgaaaattcagtgattcactacgcgctgtggaacaaagcgcatcagtcgtcagatatcactctgttagcccccgcagaattacagcaggtcgcctggggagaaaatgaaaccttcctgacgctgaaagatggcagcatgttaacggcgcgtctggtgattggcgcggacggcgctaattcctggttgcgcaacaaagccgatattccgctgactttctgggattatcagcatcacgcgctggtagcgaccattcgcacggaagaaccgcatgatgcggtggcgcggcaggttttccatggcgaaggcattctggcctttttaccgcttagcgatccgcatctttgctcgattgtctggtcactgtcgccagaggaagcgcagcggatgcagcaggcaagtgaagacgaatttaatcgcgcgttaaatatcgcttttgataatcgcctgggcttatgcaaggttgagagcgcgcgtcaggtgttcccactgacggggcgttatgcgcgccagtttgcctcgcaccgtctggcgctggtgggcgacgccgcacataccattcacccgctggcggggcagggggtaaatctcggctttatggatgctgcagagctgattgccgaactgaaacggttgcatcgtcaggggaaagacatcgggcagtacatttatctgcgtcgctatgagcgtagccgcaagcacagtgcggcgttgatgctggctggtatgcagggattccgcgatctgttttccggtaccaatccggcgaaaaaactgctgcgtgatattggtttgaaactggccgacacgcttcctggcgttaagccgcaacttatccgccaggcaatgggattaaacgatttgcctgaatggctgcgttaa

SEQ ID NO: 111 - DNA, 1179 bp, E. Coli
atgagcgtaatcatcgtcggtggcggcatggcgggcgcgacgctggcgctggctatttcccggttaagtcacggggcgctgccggtacatttgattgaagcgactgcgccagagtcacatgctcatccgggctttgatggacgagcgatagcgctggcggcgggtacctgtcagcaactggcgcgcatcggcgtctggcaatctctggcggattgcgcaactgccatcaccaccgtgcatgtcagcgatcgtggtcacgctggatttgtcaccctcgccgcagaagattaccaactggcggcgctgggacaggttgtcgaattgcacaatgtcgggcaacggctgtttgcattgctgcgtaaagcacctggcgtaacgctgcattgccctgatcgcgtggctaacgttgcccgtactcagagtcacgttgaagtgacgctggagagtggcgagacgctgacgggccgcgtgctggtagcagctgatggcacccattcagcgttagccaccgcgtgcggcgttgactggcagcaggagccttacgaacaactggccgtgattgccaacgttgctacttccgttgcgcatgaagggcgcgcttttgaacgctttacgcaacatggcccgctggcgatgttgccgatgtctgacggacgctgttcgctggtctggtgtcatccactggaacggcgcgaagaggtgttgtcgtggagtgacgagaagttttgccgtgaactccagtcggcctttggctggcgacttgggaaaattacccacgctggtaaacgcagtgcttatccgctggcgttaacccacgccgccagatctattacccatcgtaccgtgctggtgggcaatgcggcgcaaactctgcacccgattgccgggcaagggtttaacctcggtatgcgagatgtgatgagtcttgcggaaaccctgactcaggcgcaggagcgcggagaagacatgggggattacggcgtattgtgccgttatcagcagcgtcgacagagcgatcgcgaagcaaccattggcgtcacggacagccttgtacatctttttgccaaccgttgggcaccgctggttgtcgggcgcaacatcgggctgatgacgatggaattattcaccccggcacgcgatgtgctggcgcagcgcaccctcggttgggtggcgcgttga

SEQ ID NO: 112 - DNA, 1326 bp, E. Coli
atgagtgagatatcccggcaagagtttcagcgtcgccgtcaggccctggtggagcaaatgcaacccggcagcgccgcgctgatttttgctgcaccagaagtaacacgtagcgccgacagcgaatacccctatcgtcagaacagtgacttctggtacttcaccggctttaacgaaccggaagcggtgctggtgctgattaaaagcgatgacactcataaccacagcgttctgtttaaccgcgttcgcgacctgacggcggagatctggtttggccgtcgcttaggccaggatgccgcgccagagaaactgggcgttgaccgcgcactggcattcagcgaaatcaatcagcaactttatcaactacttaacggcctggatgtggtttaccatgcccagggcgaatatgcatatgctgatgtaatcgtgaacagtgcgctggaaaaactgcgtaaaggttcgcggcaaaatctcaccgcaccggcaacgatgatcgactggcgtcctgttgttcatgaaatgcgcctgttcaaatcgccagaagagattgccgtactccgccgcgcgggagaaatcaccgccatggcacatacacgggcgatggaaaaatgccgtccgggaatgttcgagtaccatctggaaggcgaaattcaccacgaatttaaccgccacggtgcgcgctatccgtcctataacaccattgtcggcagcggtgaaaacggctgcattctgcactacaccgaaaacgagtgtgaaatgcgcgacggcgacctggtgttgattgacgcgggttgtgaatacaaaggttacgctggcgatattacccgcaccttcccggtcaacggcaaattcacccaggcccagcgtgaaatctacgacattgtgctggagtctctcgaaaccagcctgcgcctgtatcgtccgggaacttccattctggaagtcactggtgaagtggtgcgcatcatggttagcggcctggtaaaactcggcatcctgaaaggtgatgttgatgaactgatcgctcagaacgcccatcgtcctttctttatgcatggccttagccactggttaggactggatgtccatgacgtgggtgtttatggtcaggatcgctcgcgcattctggaaccgggcatggtactgaccgtagagccagggctgtatattgcgccggatgcagaagtgccagaacaatatcgcggtatcggcattcgtattgaagacgacattgtgattaccgaaaccggtaacgaaaacctcaccgccagcgtggtgaaaaagccggaagaaatcgaagcgttgatggttgctgcgagaaagcaatga

SEQ ID NO: 113 - DNA, 585 bp, E. Coli
atgcttatgtctatacagaacgaaatgcctggttacaacgaaatgaaccagtatctgaaccaacaagggacgggtctgaccccagctgagatgcatggtttaatcagcgggatgatatgtggcggtaacgatgacagctcatggctaccgctacttcacgacctgacgaacgaaggcatggctttcggtcatgagctggcacaggcactgcgtaaaatgcactctgccaccagcgatgccctgcaggatgacggcttcctttttcagctttatctgcctgatggcgatgatgtcagcgttttcgatcgggctgatgcattggcaggttgggtcaatcacttcctgcttggtcttggcgttacgcaaccgaagctggataaagtgaccggcgaaaccggtgaagctatcgacgatctgcgtaacattgcgcaactgggttacgacgaagacgaagatcaggaagagcttgaaatgtcgcttgaagagatcatcgaatacgttcgtgttgccgcgctgttatgccacgacacctttactcatccgcaaccgaccgcgccagaagtacaaaaaccgactctacactaa

SEQ ID NO: 114 - DNA, 363 bp, E. Coli
atgttaaagctatttgcaaagtacacctctattggtgtgctgaacacccttatacactgggtggtttttggtgtttgtatctatgtcgcgcatacaaaccaagctcttgcaaacttcgcaggtttcgttgtggctgtgagctttagcttcttcgcgaatgcaaaattcacattcaaggcatcgactacaacgatgcgctacatgctatatgttgggttcatggggacactgagtgctactgttggatgggctgctgatagatgcgcacttcccccgatgataactcttgtcaccttctccgccatcagcctggtgtgcggtttcgtctattcaaagttcattgtctttagggatgcgaaatga

SEQ ID NO: 115 - DNA, 921 bp, E. Coli
atgaagatatctcttgtagttcctgtcttcaatgaagaagaagcgataccaattttttataaaacggtacgtgaattcgaagaattgaagtcatatgaagtggaaatcgttttcataaatgacggcagcaaagacgctacggagtcaatcattaatgctctggctgtttcagatcctctagttgttccgctgtcatttacacgcaactttggtaaagaaccagcattgtttgcagggttagaccatgcaaccggggatgcgataatcccaattgatgttgacctgcaagacccgattgaggttattcctcatcttattgaaaaatggcaagcaggtgctgatatggttcttgctaaaagatctgaccgctcaactgatggacgcctgaagcgaaaaacggctgagtggttctataagctccacaataaaataagcaatcctaaaattgaagagaatgttggtgatttcaggctgatgagccgtgatgttgtcgaaaatattaaacttatgccagaacgaaaccttttcatgaaaggtattctgagctgggtaggaggaaagacagatattgttgaatacgtgcgagcggaaagaattgctggagatacaaaatttaatggatggaaactttggaatttagcacttgagggtattacaagcttttccacattccctcttcgcatctggacatacatagggttagtggtagccagtgtagcatttatttatggggcgtggatgattttagatactatcatatttggaaatgctgttaggggatatccttcactacttgtttcaatactgtttttaggtggaattcagatgattggaataggagtattaggtgaatatattggacgcacatacattgaaaccaaaaaacgcccgaaatacatcatcaagagagtcaaaaaatga

SEQ ID NO: 116 - DNA, 1332 bp, E. Coli
atgaataaagcaataaaagtatcattgtatatatcttttgttttgattatttgcgccttatctaaaaacataatgatgttaaatacatctgatttcggaagagccattaagccattaattgaagacataccagcatttacatatgacttacctttattgtataaattgaaaggtcatattgattcaattgatagctatgagtatataagttcatatagttatattttgtatacatacgtcctgtttattagcatttttactgaatatcttgatgctagggtgttatcgttatttctaaaagtaatatatatttattcattatatgcgatatttacttcatatataaaaacagaaaggtatgtaactttatttacattctttattttagcttttcttatgtgttcttcatcaacactgtcaatgtttgcatcattctatcaagagcaaatagttataattttccttccatttttggtgtattcattaacatgcaaaaacaataaatctatgcttttgctatttttttcgttgctaataatatctactgctaaaaatcaatttatattaaccccactaatagtgtattcatattatattttttttgatagacacaaactaattattaaatctgtaatatgcgtggtgtgcttgcttgcgtcaatatttgcaatatcttattcaaaaggtgttgttgaattaaataagtaccatgcaacatacttcggtagttatctttatatgaaaaacaacgggtataaaatgccatcgtatgttgatgataagtgtgttgggttagatgcctggggtaataaattcgacatatcatttggcgcaaccccaacagaagttggaacggaatgtttcgaatctcataaagatgaaacgttttcgaatgcactctttttattggttagcaaaccaagcaccatcttcaaacttccatttgatgatggtgtgatgtctcagtataaagaaaattatttccatgtatataaaaaactacacgtaatatatggagaatcaaacatactaacgactattactaacataaaagacaatatatttaaaaacattagatttatatcattgttattattttttattgcttctatttttattagaaataataaaataaaggcatctttatttgtagtatctctttttggaatatctcaattttatgtgtcatttttcggggaaggatatagagatttaagcaagcatttatttggaatgtatttttcgttcgacctttgcttatacataacagtcgtttttttaatttataaaataattcaaagaaatcaagacaatagcgatgtaaagcactaa

SEQ ID NO: 117 - DNA, 249 bp, E. Coli
atgggcattctgtcatggattatttttgggcttattgccggtattctggcgaagtggatcatgccaggtaaagatggaggtggattctttatgactatcctgctggggatagtcggtgccgtagtcggcggatggatcagcacgctgtttggctttggtaaagtcgatggcttcaattttggcagcttcgtggttgccgttattggtgcgattgtcgtgctatttatctacaggaagattaaaagttaa

SEQ ID NO: 118 - DNA, 183 bp, E. Coli
atgggcaaagcaacgtataccgtgaccgtcaccaataacagcaatggcgtttctgtcgattatgaaacagagacgccgatgactttgctggtgccagaagtggcggctgaagtgataaaagatctggtgaataccgtacgttcttatgacacggaaaacgaacatgatgtttgtggttggtaa

SEQ ID NO: 119 - DNA, 360 bp, E. Coli
atgcttcaaatcccacagaattatattcatacgcgctcaacgcctttctggaataaacaaactgcacctgccggaatattcgaacgtcatcttgataaaggaacgcgcccgggggtttacccacgcctttccgttatgcatggggcggtcaaatatctcggctacgctgatgaacacagtgcagagcctgatcaggtgatccttatcgaagcggggcagtttgcggtgttccctccagaaaagtggcacaacattgaagccatgactgacgatacttatttcaacattgacttcttcgtggctcctgaagtcctgatggaaggtgcgcaacaacggaaagtcattcataacgggaaatga

SEQ ID NO: 120 - DNA, 741 bp, E. Coli
gtgaagttcaaagttatcgccctggcggcattaatgggtattagcgggatggcagcgcaggctaacgaattgccggatggaccgcatattgtcacctccggtacggcaagcgtggatgcggtgccagacattgccactcttgcgattgaagttaacgtggccgcgaaggatgccgctactgccaagaaacaggcagatgagcgcgtcgcacaatacatttccttccttgaactcaatcagatcgcgaaaaaagatatcagctcagcgaacttacgcacccagccagattatgattatcaggatggtaaaagtatccttaaaggctaccgcgctgtgagaacggtggaagtcacgctccgtcagttagacaaactgaattccttgctggatggcgcgctgaaggcgggtcttaacgaaattcgttctgtgtcgctgggcgtggcgcagccggatgcctataaagacaaagcgcgtaaggcagcgattgataacgcgattcatcaggcgcaggaactggcgaacggctttcatcgtaaactggggccggtatatagcgtgcgctaccatgtttccaactatcagcccagcccaatggtgcggatgatgaaagccgatgccgcgccggtgtccgcccaggaaacttacgagcaggccgctattcagtttgatgatcaggtcgatgtggtcttccagttagaacctgtggatcaacaacccgctaaaacacctgcagcacaataa

SEQ ID NO: 121 - DNA, 1395 bp, E. Coli
gtgttattactggatgcgtgctcgcaaatgtgcccgtcattcagacgattccagacagtgtttcataattcctccatttttctcccttattggctggctacactagtatcattccgcgaaacgtttcaggaagagaaactcttaacgatgaaaggtagttataaatcccgttgggtaatcgtaatcgtggtggttatcgccgccatcgccgcattctggttctggcaaggccgcaatgactcccggagtgcagccccaggggcgacgaaacaagcgcagcaatcgccagcgggtggtcgacgtggtatgcgttccggcccattagccccggttcaggcggcgaccgccgtagaacaggcagttccgcgttacctcaccgggcttggcaccattaccgccgctaataccgttacggtgcgcagccgcgtggacggccaactgatagcgttacatttccaggaaggccagcaggtcaaagcaggcgatttactggcagaaattgaccccagccagttcaaagttgcattagcacaagcccagggccaactggcaaaagataaagccacgcttgccaacgcccgccgtgacctggcgcgttatcaacaactggcaaaaaccaatctcgtttcccgccaggagctggatgcccaacaggcgctggtcagtgaaaccgaaggcaccattaaggctgatgaagcaagcgttgccagcgcgcagctgcaactcgactggagccggattaccgcaccagtcgatggtcgcgttggtctcaagcaggttgatgttggtaaccaaatctccagtggtgataccaccgggatcgtggtgatcacccagacgcatcctatcgatttagtctttaccctgccggaaagcgatatcgctaccgtagtgcaggcgcagaaagccggaaaaccgctggtggtagaagcctgggatcgcaccaactcgaagaaattaagtgaaggcacgctgttaagtctagataaccaaatcgatgccactaccggtacgattaaagtgaaagcacgctttaataatcaggatgatgcgctgtttcccaatcagtttgttaacgcgcgcatgttagtcgacaccgaacaaaacgccgtagtgatcccaacagccgccctgcaaatgggcaatgaaggccattttgtctgggtgctgaatagcgaaaacaaggtcagcaaacatctggtgacgccgggcattcaggacagtcagaaagtggtgatccgtgcaggtatttctgcgggcgatcgcgtggtgacagacggcattgatcgcctgaccgaaggggcgaaagtggaagtggtggaagcccagagcgccactactccggaagagaaagccaccagccgcgaatacgcgaaaaaaggagcacgctcctga

SEQ ID NO: 122 - DNA, 3123 bp, E. Coli
atgcaggtgttacccccgagcagcacaggcggcccgtcgcgcctgtttattatgcgtcctgtggccaccacgctgctgatggtggcgatcttactcgccgggattatcggttatcgcgccctgcccgtttcggcgctgccggaagtggactatccgaccattcaggtggtcacgctctacccaggtgccagcccggatgtcatgacctctgccgttaccgcgccgctagaacgccagttcgggcagatgtctggcctgaaacagatgtcgtcgcaaagttccggcggtgcgtcagttatcactttgcagttccagctaacattaccgctcgatgtcgccgagcaggaagtgcaggccgcgattaacgctgcgaccaacttgttgccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcgccaattcgtctgggcgatgtcgcaactgtagagcaaggtgcagaaaacagctggctcggcgcgtgggcgaacaaagaacaggccattgtgatgaatgttcagcgccagcccggtgctaacattatctccaccgccgacagcattcggcagatgctgccacagctcactgagagtctgccgaaatcggtgaaggtgacagtgctttccgatcgcaccaccaatatccgcgcatccgtcgatgatactcagtttgaattgatgatggctatcgcgctggtagtcatgattatctacctgtttttgcgcaatattccggcgaccatcattcccggtgttgctgtaccgctgtcgttaatcggcactttcgcggttatggtgtttctcgatttttcaatcaataacctgacactgatggcgttaactatcgccaccggattcgtggtcgatgacgccatcgtggtgatcgaaaacatttcccgctatatcgaaaaaggcgaaaaaccgttggcggcggcgctcaagggcgcaggtgaaatcggctttaccattatctcgctgaccttctcactgattgcggtgttgatcccactgctgtttatgggcgatatcgtcgggcgactgttccgcgaatttgctattaccctggcggtagcgattttgatctcagcggtggtgtcgctgaccctgacaccgatgatgtgcgcgcggatgctcagccaggagtcgttgcgtaaacagaaccgcttctcccgtgcctcggaaaaaatgttcgacaggataatcgccgcctatggtcgtggactggcgaaagtgctgaatcatccgtggctgaccttaagcgtggcactcagcacgctgctgcttagcgtgctgctgtgggtgttcattccgaaaggtttcttcccggtacaggacaatggcattattcagggcactttgcaggcaccgcaatccagctcctttgccaatatggcccagcgacaacgccaggtcgcggacgtgattttgcaggatccggcagtgcaaagcctgacctcatttgttggcgttgatggcactaacccgtcgctgaacagtgcacgtttacaaatcaacctcaaaccgttggatgaacgtgatgatcgggtgcaaaaagtcatcgcccgtctgcaaacggcggtagataaagtgccgggcgtcgatctcttcctgcaaccaacgcaggatctgactattgatactcaggtcagccgcacccagtaccagtttaccttgcaggccacgtcactggatgcgctcagtacctgggtgccacagttgatggaaaaactccagcaactgccacagctttctgatgtctccagcgactggcaggacaaagggctggtggcgtatgtcaatgttgatcgcgacagcgccagccgtctggggatcagcatggcggatgtcgataacgccctgtacaacgcgtttggtcagcggctgatttccactatttatactcaggccaaccagtatcgcgtggtgctggagcacaacaccgaaaataccccaggcctcgcggcgctggataccattcgcctgaccagcagcgacggcggcgtggtgccgctaagctcaattgccaaaattgagcagcgttttgcgccgctctccatcaaccatctggatcagttcccggtaacgaccatctcctttaacgtgccggataactattcgctgggcgatgcggtgcaggcgattatggacaccgaaaagacgctgaatctgccggtggatatcaccacgcagttccagggcagcaccctcgccttccagtcggcgctgggcagcactgtctggctgattgtcgcggcggtggtggcgatgtatatcgtgctcggcattctgtacgagagctttattcacccgatcaccattctctcgacgctacccaccgcaggggttggcgcactgctggcgttgctgattgctggtagcgaactggatgtgattgcgattatcggcattattttgctgatcggtatcgtgaagaagaacgccatcatgatgatcgacttcgcgctggctgctgagcgcgagcaaggcatgtcgccgcgcgaggcaatctaccaggcttgtctgttgcgttttcgtccgatcctgatgaccactctggcggctctgcttggcgcgctgccgctgatgttgagtaccggggtcggcgcggaactgcgtcgtccgttaggtatcggcatggtcggcggtctgattgtcagccaggtgctgacgctgtttaccacgccggtgatttatttgctgttcgaccgcctggcattgtggaccaaaagccgctttgcccgtcatgaagaggaggcgtaa

SEQ ID NO: 123 - DNA, 3078 bp, E. Coli
gtgaagttttttgccctcttcatttaccgcccggtggcgacgattttactgtcggttgccattaccctgtgcggcatactgggcttccgtatgctgccggtcgccccgctgccgcaggtcgattttccggtgattatcgtcagcgcctcgctgcccggtgcgtcaccagaaacaatggcgtcttccgttgccacgccgctggagcgctcacttgggcgcattgccggagtcagtgaaatgacctccagcagttcgctcggcagcacgcgtattattttgcagtttgattttgaccgggatatcaacggcgcagcgcgtgatgtgcaggcggcgatcaacgctgcacaaagtttgctgcccagtgggatgcccagccgcccgacctatcgcaaagcgaacccgtcggatgcgccaattatgatcctcacgctgacgtccgatacttattcgcagggtgaactgtacgatttcgcctcgacgcagctggctccgacgatttcgcaaatcgacggtgttggtgatgtcgatgtcggaggcagctcactgcccgccgtacgcgtcgggctgaatccgcaggcgctgtttaatcagggcgtgtcgctggacgacgtacgcaccgccgtcagcaatgccaacgtgcgtaaaccgcagggcgcgctggaagatggcactcaccgctggcagatccagaccaatgatgagctaaaaaccgccgctgaatatcagccgttgattattcactacaacaacggcggcgcggttcgtctgggcgatgtggcgacggtgaccgactcagtgcaggatgtgcgcaacgccgggatgaccaacgccaaaccggctattttactgatgatccgcaaactgccggaagccaatattatccagacggttgacagcatccgggcaaaattaccggagttgcaggaaaccattccggcggcgattgatctgcaaattgcccaggatcgctcccccaccattcgcgcctcgctggaagaagtcgagcaaacgctgattatctcggtggcgctggtgattctggtggtgtttttattcctgcgctcgggtcgcgccactattattcccgccgtttcggtgccggtttcgctgattggtacgtttgcggcgatgtacctgtgcggattcagtctcaataacctttcgttaatggcgctcaccatcgctactggtttcgtggtggatgacgccatcgtggtgctggaaaacattgcacgtcatctggaagcgggaatgaaaccgttgcaagccgcactgcaaggtactcgcgaagtcggttttacggtgctgtcgatgagtctgtcactggtggcggtgttcctgccgctgctgttgatgggcggattgccgggccgactgttacgcgaatttgccgtgacgctttctgtcgccattggtatatcgttgctggtttctctgacattaacgccaatgatgtgtggctggatgctgaaagccagcaagccgcgcgagcaaaagcgactgcgtggttttggtcgcatgttggtagccctgcaacaaggctacggcaagtcactaaaatgggtgctcaatcatacccgtctggtgggcgtggtgctgcttggcaccattgcgctgaatatctggctgtatatctcgatcccgaaaaccttcttcccggagcaggacactggcgtgttgatgggcgggattcaggcggatcagagtatttcgtttcaggcgatgcgcggtaagttgcaggatttcatgaaaattatccgtgacgatccggcagtggataatgtcaccggctttacaggcggttcgcgagtgaacagcgggatgatgtttatcaccctcaagccacgcgacgaacgcagcgaaacggcgcagcaaattatcgaccgtctgcgcgtaaaactggcgaaagaaccgggggcgaatctgttcctgatggcggtacaggatattcgcgttggtgggcgtcagtcgaacgccagctaccagtacacgttgttatccgacgacctggcggcactgcgagaatgggagccgaaaatccgcaaaaaactggcgacgttgccggaactggcggacgtgaactccgatcagcaggataacggcgcggagatgaatctggtttacgaccgcgacaccatggcacggctgggaatcgacgtacaagccgccaacagtctgttaaataacgccttcggtcagcggcaaatctcgaccatttaccagccgatgaaccagtataaagtggtgatggaagtggatccgcgctatacccaggacatcagtgcgctggaaaaaatgttcgttatcaataacgaaggcaaagcgatcccgctgtcgtatttcgctaaatggcaaccggcgaatgccccactatcggtgaatcatcagggattatcggcggcctcgaccatttcgtttaacctgccgaccggaaaatcgctctcggacgccagtgcggcgatcgatcgcgcaatgacccagcttggtgtgccttcgacggtgcgcggcagttttgccggcacggcgcaggtgttccaggagacgatgaactcgcaggtgatcctgattatcgccgccatcgccacggtgtatatcgtgctgggtatcctttacgagagttacgtacatccgctgacgattctctccaccctgccctcggcgggcgttggagcgctgttggcgctggagctgttcaatgccccgttcagcctaatcgccctgatagggatcatgctattaatcggcatcgtgaagaaaaacgccattatgatggtcgattttgcgcttgaagcccaacggcacggtaacctgacgccgcaggaagctattttccaggcctgtctgctgcgttttcgcccgattatgatgactaccctggcggcgctgtttggtgcgctgccgctggtattgtcgggcggcgacggctcggagctgcggcaacccctggggatcaccattgtcggcggactggtaatgagccagctccttacgctgtataccacgccggtggtgtatctctttttcgaccgtctgcggctgcgtttttcgcgtaaacctaaacaaacggtaaccgagtaa

SEQ ID NO: 124 - DNA, 1416 bp, E. Coli
atgacagatcttcccgacagcacccgttggcaattgtggattgtggctttcggcttctttatgcagtcgctggacaccaccatcgtaaacaccgcccttccctcaatggcgcaaagcctcggggaaagtccgttgcatatgcacatggtcattgtctcttatgtgctgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgttacagggcgttggcggcgcgatgatggtgccggtcggcagattgacggtgatgaaaatcgtaccgcgcgagcaatatatggcggcgatgacctttgtcacgttacccggtcaggtcggtccgctgctcggtccggcgctcggcggtctgctggtggagtacgcatcgtggcactggatctttttgatcaacattccggtggggattatcggtgcgatcgccacattgctgttaatgccgaactacaccatgcagacgcggcgctttgatctctccggatttttattgctggcggttggcatggcggtattaaccctggcgctggacggcagtaaaggtacaggtttatcgccgctgacgattgcaggcctggtcgcagttggcgtggtggcactggtgctttatctgctgcacgccagaaataacaaccgtgccctgttcagtctgaaactgttccgtactcgtaccttttcgctgggcctggcggggagctttgccggacgtattggcagtggcatgttgccctttatgacaccggttttcctgcaaattggcctcggtttctcgccgtttcatgccggactgatgatgatcccgatggtgcttggcagcatgggaatgaagcgaattgtggtacaggtggtgaatcgctttggttatcgtcgggtactggtagcgaccacgctgggtctgtcgctggtcaccctgttgtttatgactaccgccctgctgggctggtactacgttttgccgttcgtcctgtttttacaagggatggtcaactcgacgcgtttctcctccatgaacaccctgacgctgaaagatctcccggacaatctggcgagcagcggcaacagcctgctgtcgatgattatgcaattgtcgatgagtatcggcgtcactatcgccgggctgttgctgggactttttggttcacagcatgtcagcgtcgacagcggcaccacacaaaccgtctttatgtacacctggcttagcatggcgttgatcatcgcccttccggcgttcatctttgccagagtgccgaacgatacgcatcaaaatgtagctatttcgcggcgaaaaaggagcgcgcaatga

SEQ ID NO: 125 - DNA, 1035 bp, E. Coli
atggaaattcgcataatgctatttatattaatgatgatggttatgcctgtgagctatgcggcatgttatagtgagttatctgttcagcacaacttggttgttcagggggattttgcacttactcaaacacaaatggcgacatatgagcataattttaatgattcgtcatgcgtaagtacaaatactatcacccctatgagcccgtcggatattattgttggactttataacgataccataaaattaaatttacattttgaatggaccaataaaaacaacatcacgttgtcaaataatcagaccagtttcaccagtggttattcagttacggtgacacctgcggccagtaatgcaaaagtgaatgtttctgcggggggcggcggttcagtgatgattaatggtgttgcgacattatccagtgcttcatcatcgacacgcgggagtgccgcagtacaatttctactgtgtttattaggtggcaagtcatgggatgcatgtgtaaatagctacagaaatgcattggcacaaaatgcaggtgtctattcctttaatctgacattgtcatacaacccgataaccacaacctgcaaaccggacgatttattaattactttagacagtattcccgtttcacaattaccagccacaggtaacaaagcaacaataaatagtaaacaaggggatattattctgcgttgtaaaaatttattaggtcaacaaaatcaaacatcacggaaaatgcaggtgtatttatcaagttctgacttgttaaccaacagcaacacaatactgaaaggtgcggaagataatggcgtaggatttattcttgaaagtaatggttcgccagtcacacttttaaatatcactaacagcagtaaaggatatacaaatttaaaggaagttgcggcgaagtcaaaacttacagatacaacggtttcaattccgataacagccagttactacgtctacgatacaaacaaagttaaatctggcgcactggaggcaaccgcattaatcaacgtgaaatacgactaa

SEQ ID NO: 126 - DNA, 2481 bp, E. Coli
atgttgagaatgaccccacttgcatcagcaatcgtagcgttattgctcggcattgaagcttatgcagctgaagaaacctttgatacccattttatgataggtggaatgaaagaccagcaggttgcaaatattcgtcttgatgataatcaacccttaccggggcagtatgacatcgatatttatgtcaataagcaatggcgcgggaaatatgagattattgttaaagacaacccgcaagaaacatgtttatcaagagaagttatcaagcggttaggcattaatagcgataacttcgccagcggtaagcaatgtttaacatttgagcaacttgttcagggtgggagctatacctgggatatcggggtttttcgtctcgatttcagtgtcccgcaggcctgggtggaagaactggaaagtggctatgttccaccggaaaactgggagcggggtattaatgcgttttatacctcttattatctgagtcagtattacagcgactataaagcgtcgggtaataacaagagtacatatgtacgttttaacagcgggttaaatttactggggtggcaactgcattctgatgccagtttcagtaaaacaaataacaatccaggggtgtggaaaagcaataccctgtatctggaacgtggatttgcccaacttctcggcacgcttcgcgtgggtgatatgtacacatcaagcgatatttttgattctgttcgcttcagaggtgtgcggttgtttcgtgatatgcagatgttgcctaactcgaaacaaaattttacgccacgggtgcaggggattgctcagagtaacgcgctggtaactattgaacagaatggttttgtggtttatcagaaagaggttcctcctggcccgttcgcgattacagatttgcagttggccggtggtggagcagatcttgatgtcagcgtgaaagaggcggacggctcggtaaccacctatctggtgccttatgcagcggtgccaaatatgctgcaacccggcgtgtcgaaatatgatttagcggcgggtcgtagccatattgaaggggcgagcaaacaaagtgattttgtccaggcgggttatcagtatggttttaataatttattgacgctgtatggtggctcgatggtcgcgaataattattacgcgtttactttgggggctggctggaatacacgcattggtgccatttccgtcgatgccactaagtcgcatagtaaacaagacaacggcgatgtgtttgacgggcaaagttatcaaattgcctacaacaaatttgtgagccaaacgtcgacgcgttttggtctggcggcctggcgttattcgtcgcgtgattaccggacatttaacgatcacgtttgggcaaacaataaagataattatcgccgtgatgaaaacgatgtctatgacattgccgattattaccagaacgattttggccgcaaaaatagcttttccgccaatatgagccagtcattgccagaaggttgggggtctgtgtcattaagtacgttatggcgagattactgggggcgtagcggcagtagtaaggattatcagttgagttattccaacaacctgcgacggataagctataccctcgcggcaagccaggcttatgacgagaatcatcatgaagagaaacgttttaatatttttatatcgattccctttgattggggtgatgacgtttcgacgcctcgtcggcaaatatatatgtctaactcaacgacgtttgatgatcaggggtttgcctcaaataatacgggattatcaggaacagtagggagtcgggatcagttcaattatggtgtcaacctgagtcatcaacatcagggaaatgaaacgacagctggggcgaatttgacctggaacgcgccggttgcgacagtgaatggcagttatagtcagtcgagtacttatcgacaggctggagccagtgtttcagggggcattgtcgcctggtcgggtggcgttaatctggcgaaccgtctttccgaaacgtttgctgtgatgaatgcgccaggaattaaagatgcttatgtcaatgggcaaaaatatcgcacaacaaaccgtaatggagtggtgatatacgacggaatgacaccttatcgggaaaatcacctgatgctggatgtgtcgcaaagcgatagcgaagcagaattacgtggcaaccggaaaattgccgccccttatcgcggcgcggttgtactggttaattttgataccgatcagcgcaagccatggtttataaaagcgttaagagcagatgggcaatcattaacgtttggttatgaagtcaatgatatccatggtcataatattggcgttgtcggccagggaagtcagttatttattcgcaccaatgaagtaccgccatcggttaatgtggcaattgataagcaacaaggactttcatgcacaatcaccttcggtaaagagattgatgaaagtagaaattatatttgccagtaa

SEQ ID NO: 127 - DNA, 720 bp, E. Coli
atggccgctatcccatggcggccttttaatttaagaggcattaaaatgaaaggattattatctttactcattttttctatggtccttcctgcacatgccggaattgttatctacgggacgcgcattatttacccggcagaaaataaagaagtgatggtgcagttgatgaaccagggaaaccgttcttcgctgctgcaggcgtggattgatgatggcgatacgtcattaccaccagaaaaaattcaggttcctttcatgttaacgccaccagtggcaaaaataggggcaaattccgggcagcaagtaaaaatcaaaattatgccgaataaactgcccactaataaagaaagcattttttatctgaatgttctggatattccaccaaatagtccagagcaagaaggtaagaatgcactgaagtttgcgatgcaaaacagaattaagttgttttaccggccagcgggtattgctccggtaaataaagcgacatttaaaaaattgctggtaaatcgcagtggcaatggtttggtgataaaaaatgactcagctaattgggtgacgatttcggatgtcaaagctaataatgtcaaagtcaattatgaaactattatgattgcccccttagaaagtcagagtgttaatgtcaaaagtaataatgcaaataactggcatctgaccattatcgatgaccatggcaactatattagtgacaaaatttaa

SEQ ID NO: 128 - DNA, 543 bp, E. Coli
atgaaacgttcaattattgctgccgctgtcttttcttctttttttatgagcgctggagtatttgctgcagacgttgataccggaacattaactattaaggggaatattgcagaatctccgtgtaaattcgaagcgggtggtgattcagtaagtattaatatgccgactgtaccaaccagtgtctttgaaggtaaagctaaatattctacctatgatgatgcagtcggtgtaaccagcagcatgttaaaaattagctgcccgaaagaagttgctggtgtaaaactctcgttgattaccaacgataaaataaccggtaacgataaggcgatagccagtagcaacgataccgtgggttactatctctatttaggtgataacagcgatgtcctggatgtttctgcaccttttaacattgagagttataaaacagcggaaggtcaatatgctattccgtttaaagcaaaatacctgaaactgacagataactcagtgcaatcaggtgatgtgttatcttctctggttatgcgtgtggcgcaggattaa

SEQ ID NO: 129 - DNA, 339 bp, E. Coli
atgagttcagagcgagatctggttaattttcttggcgatttttcaatggatgtggccaaagcagttatagccggtggtgttgcaaccgctattggaagtctggcttcttttgcctgtgttagctttggctttccagtaattcttgtcggaggagcaattttactgacagggatagtgtgtacagttgttttaaatgaaatcgatgctcaatgccatttatcagaaaaattaaaatatgcaattagagatggactaaaacggcaacaggaacttgataaatggaaaagggaaaacatgactccatttatgtatgttcttaacactccacccgtgatatga

SEQ ID NO: 130 - DNA, 582 bp, E. Coli
atgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatggtggtgcgcaaaaccagcccggtgctttaccgtctgctggggatttttttgccgcttatcaccaccaactgtgcagtgctcggcgtggcgttgctgaatatcaatctcgggcacaatttcttgcagtcggcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaa

SEQ ID NO: 131 - DNA, 579 bp, E. Coli
atgaatgctatctggattgccgttgccgccgtgagcctgctgggcctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaatcaaccgttgcgccccaggtggcgaagctgtgatgctaaaaattgccgagttgcttaatgtcgagccgcagccgctggatggcgaagcgcaagagataacgcctgcgcggatggtggcggttattgatgaaaataactgtattggctgcactaaatgtattcaggcgtgtccggtagacgccatcgttggcgctacccgtgccatgcatacggtaatgagtgatctctgtacgggctgcaatttatgtgttgatccgtgcccgacgcactgcatctcgttgcaaccggtcgcagaaacacctgactcctggaaatgggatctgaacaccattcccgtgcgtatcattcccgtggaacaccatgcttaa

SEQ ID NO: 132 - DNA, 2223 bp, E. Coli
atgcttaagttattctctgcattcagaaaaaataaaatctgggatttcaacggcggcatccatccaccggagatgaaaacccagtccaacggtacacccctgcgccaggtacccctggcgcagcgttttgttattccactgaaacagcatattggcgctgaaggtgagttgtgcgttagcgtcggcgataaagtattgcgcggccagccgcttacccgtggtcgcggcaaaatgctgcctgttcacgcgcccacctcgggtaccgttacggctattgcgccccactctacggctcatccttcagctttagctgaattaagcgtgattattgatgccgatggtgaagactgctggatcccgcgcgacggctgggccgattatcgcactcgcagtcgcgaagagttaatcgagcgcatacatcagtttggtgttgccgggctgggcggtgcaggattcccgacaggcgttaaattgcagggtggcggagataagattgaaacgttgattatcaacgcggctgagtgcgagccgtacattaccgccgatgaccgtttgatgcaggattgcgcggctcaggtcgtagagggtattcgcattcttgcgcatattctgcagccacgcgaaattcttatcggcattgaagataacaaaccgcaggcgatttccatgctgcgcgcggtgctggcggactctaacgatatttctctgcgggtgattccaaccaaatatccttctggcggtgctaaacaattaacctacattctgaccgggaagcaggttccacatggcgggcgttcatccgatatcggcgtattaatgcaaaacgtcggcactgcttatgcagtgaaacgtgccgttattgatggcgagccgattaccgagcgtgttgtaaccctgactggcgaagcaatcgctcgcccgggcaacgtctgggcacggctggggacgccagtgcgtcatttattgaatgatgccggattctgcccctctgccgatcaaatggtgattatgggtggcccgctaatgggctttaccttgccatggctggatgtcccggtcgtaaagattaccaactgtctgttggctccctctgccaatgaacttggcgaaccacaggaagaacaaagctgcatccggtgtagcgcctgtgctgacgcctgccctgcggatcttttgccgcaacagttgtactggttcagcaaaggtcagcaacacgataaagctaccacgcataacattgctgattgcattgaatgtggggcttgcgcgtgggtttgcccgagcaatattcccctggtgcaatatttccgtcaggaaaaagctgaaattgcggctattcgtcaggaagaaaagcgcgccgcagaagccaaagcgcgtttcgaagcgcgccaggctcgtctggagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgcagcaaccgttgctgatccacgtaaaactgccgttgaagcagctatcgcccgcgccaaagcgcgcaagctggaacagcaacaggctaatgcggaaccagaacaacaggtcgatccgcgcaaagccgccgtcgaagccgctattgcccgtgccaaagcgcgcaagctggaacagcaacaggctaatgcggaaccagaagaacaggtcgatccgcgcaaagccgccgtcgaagccgctattgcccgtgccaaagcacgcaagctggaacagcaacaggctaatgccgagccagaacaacaggtcgatccgcgcaaagccgccgtcgaagccgctattgcccgagccaaagcgcgcaaacgggaacagcaaccggctaatgcggagccagaagaacaggttgatccgcgcaaagctgccgtcgaagcggctattgcacgcgccaaagcacgcaagctggaacagcaacaggctaatgcggtaccagaagaacaggttgatccgcgcaaagcggcagttgccgcggctattgcccgcgctcaggccaaaaaagccgcccagcagaaggttgtaaacgaggactaa

SEQ ID NO: 133 - DNA, 1059 bp, E. Coli
atggtattcagaatagctagctccccttatacccataaccagcgccagacatcgcgcattatgctgttggtgttgctcgcagccgtgccaggaatcgcagcgcaactgtggttttttggttggggtactctcgttcagatcctgttggcatcggttagtgctctgttagccgaagctctcgtactcaaactacgcaagcagtcggtagccgcaacgttgaaagataactcagcattgctgacaggcttattgctggcggtaagtattccccccctcgcgccatggtggatggtcgtgctgggtacggtgtttgcggtgatcatcgctaaacagttgtatggcggtctgggacaaaacccgtttaatccggcaatgattggttatgtggtcttactgatctccttccccgtgcagatgaccagctggttaccgccacatgaaattgcggtcaacatccctggttttatcgacgccatccaggttatttttagcggtcataccgccagtggtggtgatatgaacacactacgcttaggtattgatggcattagtcaggcgacaccgctggatacatttaaaacctctgtccgtgccggtcattcggttgaacagattatgcaatatccgatctacagcggtattctggcgggcgctggttggcaatgggtaaatctcgcctggctggctggcggcgtatggttgctatggcagaaagcgattcgctggcatattcccctcagcttcttagtaacgctggcgttatgcgcaatgttgggctggttgttctcaccagaaacactggcagcaccgcaaattcatctgctgtctggagcgaccatgctcggcgcattctttattttgactgacccggttaccgcttctacgaccaatcgtggtcgtcttattttcggcgcgcttgcgggcttattagtctggttgatccgcagtttcggcggctatcctgacggcgtggcttttgccgtcctgctggcgaacatcacggttcctctgatcgattactacacgcgtccgcgcgtctacggccatcgcaaagggtaa

SEQ ID NO: 134 - DNA, 621 bp, E. Coli
atgctgaaaactatccgaaaacacggcattacgttggcgctatttgcagcgggttcaacagggttaactgcggccatcaaccagatgaccaaaacgacgattgctgaacaggccagtctgcaacaaaaggcgttatttgatcaggtgctgccagccgaacgctataacaatgcgctggcacagagttgctatctggtaactgcgccagagttaggtaaaggtgagcatcgggtttacatcgccaaacaggatgacaaaccggtagccgccgttctggaagcaaccgcgccagatggctattccggtgcgattcagctgctggtgggagccgattttaacggcacggtacttggcacgcgcgtgacagagcaccacgaaacgccagggcttggcgataaaatcgaactgcgcctttctgactggatcacccattttgcgggtaaaaaaatcagtggtgcagatgatgcgcactgggcggtgaagaaagatggtggtgatttcgaccagttcaccggcgcgacgattactccccgcgcggtggttaatgcggtaaaacgcgccggattgtacgctcagacgttaccggcacaactttctcaacttcctgcctgtggagaataa

SEQ ID NO: 135 - DNA, 696 bp, E. Coli
gtgagcgaaattaaagacgttattgttcaggggttgtggaaaaacaactctgcgctggtccagttgctcggcctttgtcctctgttggcggtcacgtccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacattgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaagaatgaaaaagcgccgtgctgaagcagctgcagaacgtgcattgccaaacggtgaaacagggaatgtctga

SEQ ID NO: 136 - DNA, 636 bp, E. Coli
atgaataaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggcgaatacgcctgcagcgatgcttgaactgggcgttgaaggggtgaaaacctatatcaaaacgattgggctttataacagcaaagcagaaaatatcatcaaaacctgccgtatcttgctggagcagcataatggcgaggttccggaagatcgtgctgcgcttgaagccctgcccggcgtaggtcgtaaaacagccaacgtcgtattaaacactgcattcggctggccgactattgctgtcgacacgcacattttccgcgtttgtaatcgtactcaatttgcgccggggaaaaacgtcgaacaggtagaagaaaagctactgaaagtggttccagcagagtttaaagtcgactgccaccattggttgatcctgcacgggcgttatacctgcattgcccgcaagccccgctgtggctcttgtattattgaagatctttgtgaatacaaagagaaagttgacatctga

SEQ ID NO: 137 - DNA, 504 bp, E. Coli
atgaaaagacttcacaagaggttcctgttagctacgttttgcgcgttattcacagcaactctccaggccgccgatgtcactatcactgttaatggtcgggtagtcgctaaaccctgcactattcaaaccaaagaagctaacgttaatctcggggatctttatacgcgcaatctgcaacaacctggttctgcatctggctggcacaatattactttgtcattaaccgattgtccggttgaaacaagtgcagtgacggcaatcgtgacaggttcaactgacaatacgggttattacaaaaatgaaggtactgccgaaaatattcagatagagctgagggatgaccaggatgctgcgttaaaaaatggcgatagcaaaacggttattgttgatgagatcactcgtaatgcacagtttccacttaaggcaagagctatcacggtgaatggaaacgcaagccagggaacgatcgaggcgctaatcaatgtgatctacacctggcaataa

SEQ ID NO: 138 - DNA, 531 bp, E. Coli
atgaaatacaataacattattttcctcggtttatgtctggggttaaccacctattctgctttatccgcagatagcgttattaaaattagcgggcgcgtcctcgattatggctgcacagtctcatcggattcgcttaattttaccgtagatctccaaaaaaacagtgccagacaatttccaacgaccggtagcacaagtccagccgtcccttttcagattacgttaagtgaatgcagcaaagggacaacgggggttcgggttgcatttaacggtattgaggatgcagaaaataatactttgttgaaactggatgaaggaagcaatacggcctccggtttgggtatagaaatattggacgcaaatatgcgtccggtgaaactgaatgatcttcatgccgggatgcagtggatcccactggtaccagaacagaacaatattttgccttactccgctcgtctgaagtcaactcagaagtccgtcaatccgggactggtgagggcttcggcaacctttacccttgaatttcaataa

SEQ ID NO: 139 - DNA, 1149 bp, E. Coli
atgagtggttacaccgtcaagcctcctaccggagacaccaatgagcagacacaatttattgattattttaatctgttctacagtaagcgtggtcaggaacaaataagcatctctcagcagcttggaaattacggtacgacatttttcagtgccagtcgccaaagttactggaacacgtcacgcagcgaccagcaaatatcatttggattaaatgtgccgtttggtgatattacgacttcgctgaattacagctattccaataatatatggcaaaacgatcgggatcatttactcgcttttacgcttaatgttcccttcagtcattggatgcgtacagacagtcagtcggcatttcgtaattcaaacgccagttacagtatgtcaaacgatttgaaaggcggcatgaccaatctatcgggggtttatggcactctgctgccggataataacctgaattatagcgttcaggtcggtaacacccacggaggtaatacatcgtctggcaccagtggttacagttctcttaattatcgtggagcttatggtaatactaatgtcggttacagtcggagtggtgacagcagccagatttattacggaatgagtggtgggattattgctcatgctgatggcatcacctttggacagccgctgggcgacacaatggttctggttaaggctcctggtgctgataatgtcaaaatagagaaccagaccggaattcataccgactggcgtggctatgccatattaccatttgcgacagaatatagagaaaaccgtgttgctcttaacgcgaattcccttgcagataatgttgaactggatgaaaccgtggtcactgtcatcccaactcacggtgctattgccagagcaacatttaatgcacaaatcggcgggaaagtattaatgacgttgaagtacggtaataagagcgttccattcggtgcaattgtcacacacggagagaataaaaatggcagcattgtcgcggaaaatggtcaggtttatctgactggacttccacagtcagggcaattacaggtttcatggggcaaagataaaaactcaaactgtattgtcgagtacaagcttcctgaagtttctcctggtaccttactgaaccagcagacagcaatctgtcgctaa

SEQ ID NO: 140 - DNA, 417 bp, E. Coli
atgattgcgattgccgacatcttgcaagcaggagaaaagctaactgctgtggcaccttttctggcgggtattcagaacgaggaacaatacacccaggcgctggaactggtagatcatctgctgctcaacgatcctgaaaaccccttgctggatctggtgtgtgccaaaataaccgcgtgggaagaatcagcgcccgaatttgcggaatttaatgccatggctcaagccatgcctggcggtatagccgtgattcgtacccttatggatcaatatggtttaaccctttccgatctgccggaaattggcagtaaatctatggtgtcacgcgttttgagcgggaagaggaaattaacgctggaacacgctaaaaaattggcaacgcgattcggcatttctcccgccttgtttattgattaa

SEQ ID NO: 141 - DNA, 315 bp, E. Coli
atgcacctgataactcaaaaagcattgaaagatgctgcggaaaaatacccgcaacataaaacggagttggtggctctggggaacacgattgctaagggatatttcaaaaaacctgagtcattaaaagcagtattcccatctctggataacttcaaatatctggataagcattatgttttcaatgttgggggcaatgaattacgtgttgtagcaatggtcttttttgaatcgcaaaagtgctacatacgtgaagttatgacgcataaagaatacgatttctttaccgctgttcatcgtactaaggggaaaaaatga

SEQ ID NO: 142 - DNA, 7152 bp, E. Coli
ttgctatcagtatttacattttttcgctgtgctagaaagggcgcatttatgttagctcgttcagggaaggtaagcatggctacgaagaagagaagtggagaagaaataaatgaccgacaaatattatgcgggatgggaattaaactacgccgcttaactgcgggtatctgtctgataactcaacttgcgttccctatggctgcggcagcacaaggtgtggtaaacgccgcaacccaacaaccagttcctgcacaaattgccattgcaaatgccaatacggtgccctacacccttggagcgttggaatcggcccaaagcgttgccgaacgtttcggtatttcggtggctgagttacgcaaactcaaccagtttcgtacgtttgctcgaagttttgataatgtccgccagggtgatgaactggatgtcccggcacaagttagtgaaaaaaaattaaccccgccgccgggtaatagcagtgacaacctcgagcaacagatagccagtacttcacagcaaatcgggtctctgctcgccgaagatatgaacagcgagcaagcggcaaatatggcgcgtggatgggcctcttctcaggcttcaggcgcaatgacagactggttaagccgcttcggtaccgcaagaatcacgctgggcgtggatgaagattttagcctgaagaactcccagttcgattttctccatccgtggtatgaaacgcctgataatctctttttcagtcagcatactctccatcgtactgacgagcgtacgcagattaacaacggcttaggttggcgtcatttcactcccacatggatgtcgggcatcaacttctttttcgaccacgatcttagccgttaccactcccgcgccggcattggcgcggagtactggcgcgactatctaaaattaagcagtaacggctatttgcgactgaccaactggcgcagcgcacctgaactggacaacgattatgaagcacgcccggccaatggctgggatgtacgcgcagaaagctggctacccgcctggccgcaccttggcggtaaactggtctatgaacagtattatggcgatgaagtggccctgttcgataaagacgatcggcaaagtaatcctcatgccataaccgctggacttaactatacccccttcccgctgatgaccttcagcgcggagcaacgccagggtaaacagggcgaaaatgacacccgttttgccgtcgattttacctggcaacctggcagcgcaatgcagaaacagcttgacccgaatgaagtcgctgcacggcgtagccttgcaggcagccgttatgatctggtggatcgcaacaacaatatcgttctggaatatcgcaaaaaagaactggttcgcctgaccctgacagaccccgtgacagggaagtcaggagaagtgaaatcactggtttcgtcgctacaaaccaaatatgccctgaaaggctataacgtcgaagccaccgcactggaagctgccggtggcaaagtggtcacaacgggtaaagatattctggttaccctgccggcttaccggttcaccagtacgccagaaaccgataacacctggccgattgaagtcaccgccgaagatgtcaaaggcaatttgtcgaatcgtgaacagagcatggtggtcgttcaggcacctacgctaagccagaaagattcctcggtatcgttaagtacccaaacattgaacgcggattcccattcaaccgccacactgacttttattgcgcatgatgcagcaggtaatcctgttgtcgggctggtgctctcgacgcgtcacgaaggtgttcaggacatcaccctttctgactggaaagataatggtgacggaagctatacccagatcctgaccacaggagcgatgtctggcacgctgacgctgatgccacagctgaatggtgtggatgcggctaaagcccccgccgtggtgaatatcatttctgtttcgtcatcccgaactcactcgtcaattaagattgataaggaccgttatctctccggcaatcctatcgaggtgacggtagaactgagagatgaaaatgacaaacctgttaaggaacaaaaacagcaactgaataacgcagtcagcatcgacaacgtgaaaccaggagtcactacagactggaaagaaaccgcagatggcgtctataaggcgacctataccgcctataccaaaggcagtggacttactgcgaagctattaatgcaaaactggaatgaagatttgcataccgctggatttatcatcgacgccaacccgcagtcagcgaaaattgcgacattatctgccagcaataatggtgtgctcgccaatgagaatgcagcaaacaccgtctcggtcaatgtcgctgatgaaggaagcaacccaatcaatgatcataccgtcacgtttgcggtattaagcggatcggcaacttccttcaacaatcaaaacaccgcaaaaacggatgttaatggtctggcgacttttgatctgaaaagtagtaagcaggaagacaacacggttgaagtcacccttgaaaatggcgtgaaacaaacgttaatcgtcagttttgtcggcgactcgagtactgcgcaggttgatctgcagaagtcgaaaaatgaagtggttgctgacggcaatgacagcgtcacaatgaccgcgaccgtccgggatgcaaaaggcaacctgctcaatgacgtcatggtcactttcaatgttaattcagcagaggcgaaactgagccaaaccgaagtgaatagccacgacgggatcgccacagctacgctgaccagtttgaaaaatggtgattatagggttacggcctctgtgagctctggttcccaggctaatcaacaggtgaattttatcggtgatcaaagtactgctgccctgaccctcagtgtgccttcaggtgatatcaccgtcaccaacacagctccgcaatatatgactgcaaccttgcaggataaaaatggcaacccactaaaagataaagaaatcaccttctctgtgccaaacgacgtcgcaagtaagttctcgattagcaacggaggaaaaggcatgacggatagtaacggggttgcaatcgcctccctgaccggcacgttagcgggcacgcatatgatcatggctcgtctggctaacagcaatgtcagcgatgcacagccaatgacgtttgtggcggataaagacagagcggttgtcgttttgcaaacatcgaaagcggaaatcattgggaatggcgtggatgagacaactctgacagcaacagtgaaagatccgtcgaatcatccggtggcggggataacggtaaacttcaccatgccacaggacgttgcggcaaactttacccttgaaaataacggtattgccatcactcaggccaatggggaagcgcatgtcacgctgaaaggtaaaaaagcgggcacgcatacggttaccgcaacgctgggtaataacaataccagtgattcgcagccggtaacatttgtggcggacaaagcctcggctcaggttgtcctgcagatatcaaaagatgagatcacaggtaatggcgtcgatagcgcaacgctaactgcaacggttaaagatcagttcgacaatgaggtgaataatcttccggtaacattcagctcagcctcttcaggactcaccctgaccccgggagtaagtaataccaacgagtctggcatcgcgcaggccactctcgcaggcgttgcctttggtgagaagacggttactgcatcactggctaataatggtgccagcgacaacaaaactgtgcattttattggcgacacagcggcggcaaaaattatcgagttggcgcctgtcccagacagcataatcgccggtaccccgcagaacagctccggcagcgtcatcaccgccacagtcgttgataataatggctttccggtgaaaggtgtgactgtgaacttcaccagcaacgcagcgacagccgaaatgacgaacggcggtcaagccgtgacgaacgaacagggtaaggctaccgtcacttataccaatacccgctcctcgatagaatcaggagcgagaccggataccgttgaggccagtctggaaaatggtagctccacgcttagcacatcaattaatgtcaacgctgatgcgtctacggcacatctcaccttgctacaggcactttttgatacagtctccgcaggcgagacaaccagtctgtatattgaggtgaaggataattacggcaacggtgtcccccagcaggaggtaaccctcagcgtttcaccaagtgaaggcgtgacccccagtaataacgctatatatactaccaaccacgacggcaatttttacgcaagctttaccgctacaaaagccggggtttatcaattgacggcaaccctcgaaaatggcgattcgatgcaacaaacagtgacctatgtgccgaacgtcgcgaatgctgaaatcacgctggcagcctcgaaggatccggtgattgccgacaataacgatctcacgacactaacagcaacagtcgctgatacagagggcaatgcgatagccaacactgaggtaacatttactctgccggaagatgtgaaggcgaacttcacgctgagcgatggcggtaaagtgattactgatgctgaaggcaaagcgaaagtcacgctgaaaggtacaaaagcaggcgctcatactgttacagcatcgatgactggcggtaagagtgagcagttggtggtgaactttattgcggatacgctcactgcgcaggttaatcttaacgttaccgaggacaattttatcgctaataacgtcgggatgaccaggctgcaggcaacagtgactgatggaaacggcaacccgttagccaatgaggcggtgacattcacgctaccggcagatgtgagcgcaagctttactctcggacaaggcggttccgccattactgatatcaacggcaaggctgaagttacactgagcggtacaaaatccggcacctaccccgtgacagttagcgtgaacaattatggtgtcagtgatacgaaacaggtgactttgattgccgatgctggtaccgcaaaactagcctccttaacctctgtatactcattcgtcgtcagcacgaccgagggcgcaaccatgacggcaagcgtcactgacgctaacggcaacccggtagaaggcataaaagttaatttccgcggaacctccgtcacgctaagcagcaccagcgttgaaacggatgatcggggtttcgctgaaattcttgtgacaagcaccgaggtcggactgaaaacagtttcagcctctctggcagataaacctactgaagtcatctcgcgattactgaatgccagtgcagatgttaattctgcgacgattaccagtctggagataccggaaggtcaggtaatggtcgcacaagacgtagcagttaaagctcacgttaacgaccagtttggcaacccggttgcgcatcaacccgtgacattcagtgcagagccatcctcgcaaatgatcatcagccagaatacggtctctactaatacgcagggtgtagccgaggtcaccatgacgcccgaaagaaacggttcgtatatggtgaaagcatccctgccgaatggagcctcacttgagaaacaactggaggctattgatgaaaaactgacactcacggcgtccagtccgcttatcggtgtctatgcccctacaggcgctactctgacggcaacgctaacctctgcaaatggcactccagtggagggtcaggtcatcaactttagcgtaacgccagaaggggcgacgttaagtggcggaaaagtgagaactaactcttcaggtcaggctccagtcgttttgaccagcaataaagtcggtacatatacggtgactgcatctttccataacggcgtaacaatacagacacagacaaccgtgaaagtcactggcaactcaagcaccgcccatgttgctagctttatcgctgatccatcgactatcgccgccaccaacactgatttaagtaccttaaaggcaacggttgaggatggcagtggtaacctgatcgaaggtctcactgtgtacttcgccttaaaaagcggctctgccacattaacgtcattaacagcggtgaccgatcaaaacggaatcgcgacaacaagcgtgaaaggagcgatgacaggtagcgtcacggtaagcgcagtcacgaccgctggtggaatgcaaacagtagatataacgctggtggctggcccggcagacacctcgcagtccgtccttaagagcaatcggtcatcactgaaaggggactataccgatagtgctgaattacgtcttgttctgcacgatatatcaggcaatccgatcaaagtttctgaagggatggaatttgtgcaatcaggtactaacgtgccctatataaaaattagcgcaattgattacagtctaaatatcaacggtgattacaaagccactgttacaggaggcggagagggtatcgcaacgctgatccctgtattgaatggtgttcatcaagctggtctgagtaccacaatacaattcactcgcgcagaagacaaaataatgagcggtacagtatcagtcaatggtactgacctaccgacaactacattcccttcgcaggggttcaccggggcgtattatcagttgaataatgacaactttgccccaggaaaaacggcggctgattatgagttttcaagctctgcctcctgggtcgatgttgatgctaccggtaaagtgacatttaaaaatgtcggcagcaattcggaaaggattacggcgacgccaaaatcaggaggccctagctatgtatacgaaatccgtgtgaagagttggtgggtgaacgccggcgaggctttcatgatatacagccttgctgaaaatttttgcagcagcaatggctacacgctccccagagcaaactatttaaaccactgtagttcccgaggcatcgggtcactgtacagtgaatggggagatatggggcattacacgactgacgctggttttcaatcaaatatgtattggtcatctagtcccgcaaactcaagcgaacaatacgtagtttccctggcaacaggtgatcaaagcgtatttgaaaagcttgggtttgcttatgcgacatgttataaaaacctgtga

SEQ ID NO: 143 - DNA, 186 bp, E. Coli
atgagcaaaggcgcattatatgaatttaacaatccagatcaactgaaaatacctctccctcataaacacatagcgtcaacattcaatgacataatgagtaaagatgttggttatgcatacgtatcattactctatgcctgtcccttaaaaacccactcattaagactgaatccattcagcaaatga

SEQ ID NO: 144 - DNA, 1197 bp, E. Coli
atgcaggtggctgaacagcgcattcagctagctgaagcccaggcgaaggcagttgccactcaggatggtccgcagatcgacttttcggcggatatggagcggcaaaaaatgtcggcagaaggcttaatggggccgtttgctctgaacgatccggccgcaggtacgaccggcccgtggtacaccaacggtacttttggcttaacggcgggctggcatctcgatatctggggaaagaatcgggcggaggttactgcccgcctgggtacggttaaagcacgggcggcggaacgcgagcaaacccgccaattgctggctggcagcgtagcccgcctgtactgggagtggcaaacccaggcggcgttaaacacggtcttgcagcaaatagaaaaagagcagaacaccattatcgcgaccgatcgccagctatatcagaacgggattacttcttcagttgaaggtgtggaaaccgatattaatgccagcaaaacccggcagcagctcaacgatgtcgcggggaaaatgaaaattattgaggcacggttaagcgcacttacaaataaccagacaaagtcattgaagcttaaaccggtcgcgttgccgaaagtggcaagccagcttcctgatgaactggggtactccttactggcccggcgggcagatttgcaggcggcgcactggtacgttgagtcatcgctaagcaccattgatgcggcaaaagcggcattttatcctgacatcaacctgatggccttcctgcaacaggatgcgttgcacttaagcgatctgttccgtcattccgcgcagcaaatgggcgttacggcaggcctgacgctacccattttcgatagtggtcgtcttaacgccaatctcgatatcgcaaaagccgaaagcaacttgtctatcgccagctacaacaaagcggtggttgaagcggtgaatgacgtggcgcgggcagccagtcaggttcagacactggcggagaaaaaccagcatcaggcgcaaattgagcgcgatgccttgcgtgtggtaggtcttgcgcaggcgcgctttaacgcgggcatcattgctggttcccgcgtcagcgaagccagaatccccgcgctgcgtgagcgggccaatggcctgttattgcaagggcagtggctggatgcctccattcaactcactggtgcgttgggcggggggtacaaacgctga

SEQ ID NO: 145 - DNA, 291 bp, E. Coli
atgtattgccacgcgaaactaaaaaatatatcgcaacacacggtaatctccgcgcaccttttcttacctgattattcccccatgaatcgtgattccttttatccagccatcgcctgttttccgctgttactgatgctggccgggtgtgcgcctatgcatgaaacccgccaggcgttaagccagcaaacgcccgctgcacaagttgacaccgcattacccacggcgctgaaaatggttggccagacagccaatggtggctggagtatcacgataatcaactcacttccttaa

SEQ ID NO: 146 - DNA, 948 bp, E. Coli
atgcgtgtgttactggcaccgatggagggagtgcttgactctctggtgcgtgaattgctgaccgaagttaacgactacgatctgtgcatcaccgagtttgtccgcgtggtggatcaactgctgccggtaaaagtctttcatcgcatttgccctgagctacaaaacgccagccggacaccatctggtacgctggtgcgcgtgcagttgttaggtcagttcccacaatggctggcagagaacgccgcccgtgcggtggagttaggttcctggggcgtggatctcaattgcggctgcccgtcgaaaacggttaacggtagcggcggcggggcgacgttactcaaagatcctgaactcatctaccagggtgcaaaagcgatgcgtgaagctgtaccggcgcatttgcccgtcagcgtgaaagtgcgtctgggctgggacagcggtgagaagaaatttgaaatcgccgatgcggttcaacaggctggcgctacggagctggtggtgcatgggcggacgaaagagcagggttaccgcgcggagcatattgactggcaggcgattggcgatattcgccagcggctgaatattccggtgattgccaacggtgaaatctgggactggcagagcgcgcaacaatgcatggcgatcagcggctgcgacgcagtgatgattggtcgcggggcgctcaatattcccaacctgagccgggtggtaaaatataacgaaccgcgaatgccgtggccggaggtggttgctttgctgcaaaaatatacccgtctggaaaagcagggcgataccgggttatatcacgttgcgcggattaaacagtggttgagttatttgcgtaaagaatacgatgaagcaacggaattatttcagcatgttcgggtgttgaataattcccctgatattgcaagggctattcaggcaattgatatcgagaaactctaa

SEQ ID NO: 147 - DNA, 891 bp, E. Coli
atgacaatatcgacaacttccacgccgcatgatgcggtatttaaatcttttttacgccatccagacaccgcgcgggattttattgatattcatcttcccgcgccgctgcgcaaactgtgtgatttaacgacgcttaaactggaaccaaacagttttattgatgaagacctgcggcaatattattccgacctcttgtggtctgtgaaaacgcaggagggagtgggttatatttatgtagtgatagagcaccaaagtaagccggaagaattaatggcttttcgcatgatgcgttattccattgcggcaatgcaaaaccatcttgatgcgggctataaagagcttccattggtgctcccgatgctgttttatcatggttgcagaagtccttatccttattcactctgctggcttgatgaatttgccgagcctgctatagcccgcaaaatatattcatcggcttttccgttggtggatattaccgtggtgccggatgacgagattatgcaacaccgcaaaatggcgctgttggagttaattcagaaacatattcgtcagcgcgatctgttgggattagtcgaccaaattgtttcgctgctagttacagggaacactaatgacagacagctaaaagccctgtttaattacgtattacaaacaggggatgcccagcgttttcgtgcatttattggtgagatagcggaacgcgcaccacaagaaaaggagaaactgatgaccattgctgacagattacgtgaagaaggcgcaatgcagggcaaacacgaagaagccctgcgtattgctcaggagatgctggatagaggtttagacagagagttagttatgatggtgacccgactttcaccagacgatcttatcgcgcaaagccactaa

SEQ ID NO: 148 - DNA, 1668 bp, E. Coli
gtggctcaattcgtttataccatgcatcgtgtcggcaaagttgttccgccgaaacgtcatattttgaaaaacatctctctgagtttcttccctggggcaaaaattggtgtcctgggtctgaatggcgcgggtaagtccaccctgctgcgcattatggcgggcattgataaagacatcgaaggtgaagcgcgtccgcagccagacatcaagattggttatctgccgcaggaaccgcagctgaacccggaacacaccgtgcgtgagtccattgaagaagcggtttcagaagtggttaacgccctgaaacgcctggatgaagtgtatgcgctgtacgccgatccggatgccgattttgacaagctggccgctgaacaaggccgtctggaagagatcattcaggctcacgacggtcataatctgaacgtacagctggagcgtgcggcggatgcgctacgtctgccggactgggacgcgaaaatcgctaacctctccggtggtgaacgtcgtcgcgtagcgttgtgccgcctgctgctggaaaaaccagacatgctgctgctcgacgaaccgaccaaccacctggatgccgaatccgtggcctggctggaacgcttcctgcacgacttcgaaggcaccgttgtggcgattacccacgaccgttacttcctcgataacgttgcaggctggatcctcgaacttgaccgcggtgaaggtattccgtgggaaggtaactactcctcctggctggagcagaaagatcagcgcctggcgcaggaagcttcacaagaagcggcgcgtcgtaagtcgattgagaaagagctggaatgggtacgtcaaggtactaaaggccgtcagtcgaaaggtaaagcacgtctggcgcgctttgaagaactgaacagcaccgaatatcagaaacgtaacgaaaccaacgaactgtttattccacctggaccgcgtctgggcgataaagtgctggaagtcagcaacctgcgtaaatcctatggcgatcgtctgctgattgatgacctgagcttctcgatcccgaaaggagcgatcgtcgggatcatcggtccgaacggtgcgggtaaatcgaccctgttccgtatgatctctggtcaggaacagccggacagcggcaccatcactttgggtgaaacggtgaaactggcgtcggttgatcagttccgtgactcaatggataacagcaaaaccgtttgggaagaagtttccggcgggctggatatcatgaagatcggcaacaccgagatgccaagccgcgcctacgttggccgctttaactttaaaggggttgatcagggtaaacgcgttggtgaactctccggtggtgagcgcggtcgtctgcatctggcgaagctgctgcaggttggcggcaacatgctgctgctcgacgaaccaaccaacgacctggatatcgaaaccctgcgcgcgctggaaaacgccctgctggagttcccgggctgtgcgatggttatctcgcacgaccgttggttcctcgaccgtatcgccacgcacattctggattaccaggatgaaggtaaagttgagttcttcgaaggtaactttaccgagtacgaagagtacaagaaacgcacgctgggcgcagacgcgctggagccgaagcgtatcaagtacaagcgtattgcgaagtaa

SEQ ID NO: 149 - DNA, 522 bp, E. Coli
atgtcaaagccaaaatacccttttgaaaagcgccttgaagtcgtgaatcactacttcacaactgatgatggttacaggatcatctcggcacgttttggtgtcccccgaacccaggtcaggacatgggttgccctctatgaaaaacatggagaaaaaggtttaattcccaaacctaaaggcgttagtgctgatccagagttgcgtattaaggtcgtgaaagctgtgatcgagcagcacatgtcccttaatcaggctgctgctcactttatgcttgctggtagtggttctgtagccaggtggctgaaggtctatgaagagcgcggagaagctggtttacgcgcgctcaagattggcaccaaaagaaacattgcaatatcagttgatccagaaaaagcggcatcagcattggagctgtcaaaagaccgacgcattgaggatcttgaaaggcaagttcgatttcttgaaacgcggcttatgtatctaaaaaagctgaaagccttagctcatcccacgaaaaagtga

SEQ ID NO: 150 - DNA, 852 bp, E. Coli
gtgaaagtactcaacgagctaaggcagttttatcctcttgatgagcttctcagggctgcggagataccgcgcagtacgttttattatcatctaaaggctctcagcaagcctgacaagtatgcggacgttaaaaagcgtattagtgagatttatcacgagaatagaggccgatacggataccgtagggtaacgctgtctcttcatcgagaagggaaacagattaaccataaagctgttcagcgcctgatgggaaccctctcacttaaagcagcgattaaggtcaagcgataccgctcttacagaggagaggtagggcaaaccgcccctaatgttctccaaagagatttcaaggctacgcggccaaacgagaagtgggttaccgatgttactgaatttgcagtcaatgggcgcaagctgtatttgtctccagtaatagatctcttcaacaacgaagttatttcttacagcctttcggaaagaccagtgatgaacatggttgagaatatgctcgatcaggcattcaaaaagcttaatcctcacgagcatcctgttctgcactctgaccagggatggcagtatcgtatgagaagatatcaaaatatccttaaagaacatggtattaaacaaagcatgtccagaaaaggcaattgtctggataatgctgtggtggagtgtttctttggaaccttaaagtcggagtgtttttatcttgatgagttcagtaatataagcgaactgaaggatgctgttacggaatatattgaatactacaacagcagaagaattagcctgaaattaaaaggtctgactccaattgaatatcggaatcagacctatatgcctcgtgtttaa

SEQ ID NO: 151 - DNA, 117 bp, E. Coli
atgaaagttcgtgcttccgtcaagaaattatgccgtaactgcaaaatcgttaagcgtgatggtgtcatccgtgtgatttgcagtgccgagccgaagcataaacagcgccaaggctga

SEQ ID NO: 152 - DNA, 1332 bp, E. Coli
atggctaaacaaccgggattagattttcaaagtgccaaaggtggcttaggcgagctgaaacgcagactgctgtttgttatcggtgcgctgattgtgttccgtattggctcttttattccgatccctggtattgatgccgctgtacttgccaaactgcttgagcaacagcgaggcaccatcattgagatgtttaacatgttctctggtggtgctctcagccgtgcttctatctttgctctggggatcatgccgtatatttcggcgtcgatcattatccagctgctgacggtggttcacccaacgttggcagaaattaagaaagaaggggagtctggtcgtcgtaagatcagccagtacacccgctacggtactctggtgctggcaatattccagtcgatcggtattgctaccggtctgccgaatatgcctggtatgcaaggcctggtgattaacccgggctttgcattctacttcaccgctgttgtaagtctggtcacaggaaccatgttcctgatgtggttgggcgaacagattactgaacgaggtatcggcaacggtatttcaatcattatcttcgccggtattgtcgcgggactcccgccagccattgcccatactatcgagcaagcgcgtcaaggcgacctgcacttcctcgtgttgctgttggttgcagtattagtatttgcagtgacgttctttgttgtatttgttgagcgtggtcaacgccgcattgtggtaaactacgcgaaacgtcagcaaggtcgtcgtgtctatgctgcacagagcacacatttaccgctgaaagtgaatatggcgggggtaatcccggcaatcttcgcttccagtattattctgttcccggcgaccatcgcgtcatggttcgggggcggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtaatgacccgcctgaccctggttggtgcgctgtatattacctttatctgcctgatcccggagttcatgcgtgatgcaatgaaagtaccgttctacttcggtgggacctcactgcttatcgttgttgtcgtgattatggactttatggctcaagtgcaaactctgatgatgtccagtcagtatgagtctgcattgaagaaggcgaacctgaaaggctacggccgataa

SEQ ID NO: 153 - DNA, 435 bp, E. Coli
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgtaaagcagcgattacagccgaaattcgtctgtctgacctggctaaagtagaaggcggtgtagtagacctgaacacgctgaaagcggctaacattatcggtatccagatcgagttcgcgaaagtgatcctggctggcgaagtaacgactccggtaactgttcgtggcctgcgtgttactaaaggcgctcgtgctgctatcgaagctgctggcggtaaaatcgaggaataa

SEQ ID NO: 154 - DNA, 180 bp, E. Coli
atggcaaagactattaaaattactcaaacccgcagtgcaatcggtcgtctgccgaaacacaaggcaacgctgcttggcctgggtctgcgtcgtattggtcacaccgtagagcgcgaggatactcctgctattcgcggtatgatcaacgcggtttccttcatggttaaagttgaggagtaa

SEQ ID NO: 155 - DNA, 504 bp, E. Coli
atggctcacatcgaaaaacaagctggcgaactgcaggaaaagctgatcgcggtaaaccgcgtatctaaaaccgttaaaggtggtcgtattttctccttcacagctctgactgtagttggcgatggtaacggtcgcgttggttttggttacggtaaagcgcgtgaagttccagcagcgatccagaaagcgatggaaaaagcccgtcgcaatatgattaacgtcgcgctgaataacggcactctgcaacaccctgttaaaggtgttcacacgggttctcgcgtattcatgcagccggcttccgaaggtaccggtatcatcgccggtggtgcaatgcgcgccgttctggaagtcgctggggttcataacgttctggctaaagcctatggttccaccaacccgatcaacgtggttcgtgcaactattgatggcctggaaaatatgaattctccagaaatggtcgctgccaagcgtggtaaatccgttgaagaaattctggggaaataa

SEQ ID NO: 156 - DNA, 354 bp, E. Coli
atggataagaaatctgctcgtatccgtcgtgcgacccgcgcacgccgcaagctccaggagctgggcgcaactcgcctggtggtacatcgtaccccgcgtcacatttacgcacaggtaattgcaccgaacggttctgaagttctggtagctgcttctactgtagaaaaagctatcgctgaacaactgaagtacaccggtaacaaagacgcggctgcagctgtgggtaaagctgtcgctgaacgcgctctggaaaaaggcatcaaagatgtatcctttgaccgttccgggttccaatatcatggtcgtgtccaggcactggcagatgctgcccgtgaagctggccttcagttctaa

SEQ ID NO: 157 - DNA, 534 bp, E. Coli
atgtctcgtgttgctaaagcaccggtcgttgttcctgccggcgttgacgtaaaaatcaacggtcaggttattacgatcaaaggtaaaaacggcgagctgactcgtactctcaacgatgctgttgaagttaaacatgcagataataccctgaccttcggtccgcgtgatggttacgcagacggttgggcacaggctggtaccgcgcgtgccctgctgaactcaatggttatcggtgttaccgaaggcttcactaagaagctgcagctggttggtgtaggttaccgtgcagcggttaaaggcaatgtgattaacctgtctctgggtttctctcatcctgttgaccatcagctgcctgcgggtatcactgctgaatgtccgactcagactgaaatcgtgctgaaaggcgctgataagcaggtgatcggccaggttgcagcggatctgcgcgcctaccgtcgtcctgagccttataaaggcaagggtgttcgttacgccgacgaagtcgtgcgtaccaaagaggctaagaagaagtaa

SEQ ID NO: 158 - DNA, 393 bp, E. Coli
atgagcatgcaagatccgatcgcggatatgctgacccgtatccgtaacggtcaggccgcgaacaaagctgcggtcaccatgccttcctccaagctgaaagtggcaatcgccaacgtgctgaaggaagaaggttttattgaagattttaaagttgaaggcgacaccaagcctgaactggaacttactctgaagtatttccagggcaaagctgttgtagaaagcattcagcgtgtcagccgcccaggtctgcgcatctataaacgtaaagatgagctgccgaaagttatggcgggtctgggtatcgcagttgtttctacctctaaaggtgttatgactgatcgtgcagcgcgccaggctggtcttggtggcgaaattatctgctacgtagcctaa

SEQ ID NO: 159 - DNA, 306 bp, E. Coli
atggctaagcaatcaatgaaagcacgcgaagtaaaacgcgtagctttagctgataaatacttcgcgaaacgcgctgaactgaaagcgatcatctctgatgtgaacgcttccgacgaagatcgttggaacgctgttctcaagctgcagactctgccgcgtgattccagcccgtctcgtcagcgtaaccgctgccgtcaaacaggtcgtccgcatggtttcctgcggaagttcgggttgagccgtattaaggtccgtgaagccgctatgcgcggtgaaatcccgggtctgaaaaaggctagctggtaa

SEQ ID NO: 160 - DNA, 540 bp, E. Coli
atggcgaaactgcatgattactacaaagacgaagtagttaaaaaactcatgactgagtttaactacaattctgtcatgcaagtccctcgggtcgagaagatcaccctgaacatgggtgttggtgaagcgatcgctgacaaaaaactgctggataacgcagcagcagacctggcagcaatctccggtcaaaaaccgctgatcaccaaagcacgcaaatctgttgcaggcttcaaaatccgtcagggctatccgatcggctgtaaagtaactctgcgtggcgaacgcatgtgggagttctttgagcgcctgatcactattgctgtacctcgtatccgtgacttccgtggcctgtccgctaagtctttcgacggtcgtggtaactacagcatgggtgtccgtgagcagatcatcttcccagaaatcgactacgataaagtcgaccgcgttcgtggtttggatattaccattaccactactgcgaaatctgacgaagaaggccgcgctctgctggctgcctttgacttcccgttccgcaagtaa

SEQ ID NO: 161 - DNA, 315 bp, E. Coli
atggcagcgaaaatccgtcgtgatgacgaagttatcgtgttaaccggtaaagataaaggtaaacgcggtaaagttaagaatgtcctgtcttccggcaaggtcattgttgaaggtatcaacctggttaagaaacatcagaagccggttccggccctgaaccaaccgggtggcatcgttgaaaaagaagccgctattcaggtttccaacgtagcaatcttcaatgcggcaaccggcaaggctgaccgtgtaggctttagattcgaagacggtaaaaaagtccgtttcttcaagtctaacagcgaaactatcaagtaa

SEQ ID NO: 162 - DNA, 372 bp, E. Coli
atgatccaagaacagactatgctgaacgtcgccgacaactccggtgcacgtcgcgtaatgtgtatcaaggttctgggtggctcgcaccgtcgctacgcaggcgtaggcgacatcatcaagatcaccatcaaagaagcaattccgcgtggtaaggtcaaaaaaggtgatgtgctgaaggcggtagtggtgcgcaccaagaagggtgttcgtcgcccggacggttctgtcattcgcttcgatggtaatgcttgtgttcttctgaacaacaacagcgagcagcctatcggtacgcgtatttttgggccggtaactcgtgagcttcgtagtgagaagttcatgaaaattatctctctggcaccagaagtactctaa

SEQ ID NO: 163 - DNA, 567 bp, E. Coli
atgtttaaaggacaaaaaacattggccgcactggccgtatctctgctgttcactgcacctgtttatgctgctgatgaaggttctggcgaaattcactttaagggggaggttattgaagcaccttgtgaaattcatccagaagatattgataaaaacatagatcttggacaagtcacgacaacccatataaaccgggagcatcatagcaataaagtggccgtcgacattcgcttgatcaactgtgatctgcctgcttctgacaacggtagcggaatgccggtatccaaagttggcgtaaccttcgatagcacggctaagacaactggtgctacgcctttgttgagcaacaccagtgcaggcgaagcaactggggtcggtgtacgactgatggacaaaaatgacggtaacatcgtattaggttcagccgcgccagatcttgacctggatgcaagctcatcagaacagacgctgaactttttcgcctggatggaacaaattgataatgcagtcgatgtcacggcaggtgaagtaaccgctaacgcaacctacgtgctggattataaataa

SEQ ID NO: 164 - DNA, 1284 bp, E. Coli
atggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttccgcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaa

SEQ ID NO: 165 - DNA, 1434 bp, E. Coli
atgaaagtaacgctgccagagtttgaacgtgcaggagtgatggtggttggtgatgtgatgctggatcgttactggtacggccccaccagtcgtatctcgccggaagcgccggtgcccgtggttaaagtgaataccatcgaagaacgtccgggcggcgcggctaacgtggcgatgaatatcgcttctctcggtgctaatgcacgcctggtcgggttgacgggcattgacgatgcagcgcgcgcgctgagtaaatctctggccgacgtcaacgtcaaatgcgacttcgtttctgtaccgacgcatccgaccattaccaaattacgggtactttcccgcaaccaacagctgatccgtctggattttgaagaaggtttcgaaggtgttgatccgcagccgctgcacgagcggattaatcaggcgctgagttcgattggcgcgctggtgctttctgactacgccaaaggtgcgctggcaagcgtacagcagatgatccaactggcgcgtaaagcgggtgttccggtgctgattgatccaaaaggtaccgattttgagcgctaccgcggcgctacgctgttaacgccgaatctctcggaatttgaagctgttgtcggtaaatgtaagaccgaagaagagattgttgagcgcggcatgaaactgattgccgattacgaactctcggctctgttagtgacccgttccgaacagggtatgtcgctgctgcaaccgggtaaagcgccgctgcatatgccaacccaagcgcaggaagtgtatgacgttaccggtgcgggcgacacggtgattggcgtcctggcggcaacgctggcagcgggtaattcgctggaagaagcctgcttctttgccaatgcggcggctggcgtggtggtcggcaaactgggaacctccacggtttcgccgatcgagctggaaaatgctgtacgtggacgtgcagatacaggctttggcgtgatgaccgaagaggaactgaagctggccgtagcggcagcgcgtaaacgtggtgaaaaagtggtgatgaccaacggtgtctttgacatcctgcacgccgggcacgtctcttatctggcaaatgcccgcaagctgggtgaccgcttgattgttgccgtcaacagcgatgcctccaccaaacggctgaaaggggattcccgcccggtaaacccactcgaacagcgtatgattgtgctgggcgcactggaagcggtcgactgggtagtgtcgtttgaagaggacacgccgcagcgcttgatcgccgggatcttgccagatctgctggtgaaaggcggcgactataaaccagaagagattgccgggagtaaagaagtctgggccaacggtggcgaagtgttggtgctcaactttgaagacggttgctcgacgaccaacatcatcaagaagatccaacaggataaaaaaggctaa

SEQ ID NO: 166 - DNA, 2841 bp, E. Coli
atgaagccgctctcttcaccgttacagcagtactggcagaccgttgttgagcggctgccagagcctttagccgaggaatcacttagcgcacaggcgaagtcagtacttacttttagtgattttgtgcaggacagcgtgattgcgcatccagagtggctgacggaactggaaagccaaccgccgcaggccgacgaatggcagcattacgcggcatggttgcaggaggcgctctgtaatgtgagtgacgaagccgggttaatgcgcgagctgcggctattccggcggcgcattatggtgcgcatcgcctgggcgcaaacgctggcactggttactgaagagagcatattgcagcagctcagctatctggcggagacgctgattgttgcggcgcgtgactggctgtatgacgcctgctgccgcgagtggggaacgccgtgcaatgcgcagggcgaagcgcaaccgctgctgattttaggcatgggtaagctgggcggtggggagctgaatttctcctctgatatcgatctgatttttgcctggccggaacatggttgtacgcagggtggacgccgggaactggataacgcgcagttttttacccgcatggggcagcggctgattaaagtgctggatcaaccaacgcaggatggcttcgtctatcgcgtggatatgcggctgcgtccgtttggcgaaagtggcccgctggtgctgagctttgccgcgttggaagattattaccaggagcaggggcgcgactgggagcgttacgcgatggtcaaggcgcggattatgggcgatagcgaaggcgtctatgctaacgagttgcgtgcgatgctgcgcccgtttgttttccgtcgttacatcgatttcagcgtgattcagtcgctgcgcaacatgaaagggatgattgcccgtgaagtgcgtcgacgtggtttgaccgacaatatcaaactcggcgcaggcggcattcgcgaaattgaatttatcgttcaggtgttccagctcattcgcggcggacgcgaaccgtcgctgcaatcgcgctctttactgccaacgctcagcgccattgccgagctgcatctgctttctgaaaacgatgctgaacaattgcgagtggcgtatctgttcctgcggcgtctggaaaacctgctgcaaagcattaacgacgaacaaacccagacgcttccttctgatgagcttaatcgtgcgcggctggcgtgggcgatggactttgctgactggccgcaactgaccggggcgctgaccgcacatatgaccaatgtgcgccgggtgtttaatgaattgattggcgacgatgaaagtgaaactcaggaagagtcgctgtcggaacagtggcgtgagctgtggcaggatgcgttgcaggaagatgacactacgccagtgctggcgcatcttagcgaggatgatcgcaaacaggtgctaacgctgattgccgatttccgcaaagagctggataagcgcaccatcgggccgcgaggacgtcaggtgctcgaccatctgatgccgcatctgctaagtgatgtctgtgcgcgtgaagacgctgccgttacgctgtcgcgcattaccgccttgctggtggggattgttacccgcaccacctatttagaattgctcagtgaattccccgcggcgcttaaacatttgatttctctgtgtgccgcgtcgccgatgattgccagccagctggcgcgttatccattattgctggatgaattgctcgatccaaacaccctttaccagccgacggcgaccgatgcctaccgcgatgagttgcgccagtatttgctgcgcgtgccggaagatgacgaagagcaacagcttgaggcgctgcgtcagttcaaacaggcgcagctgttacgcatcgccgcagcggatatcgccggtacgctaccggtgatgaaagtgagcgatcacttaacctggctggcggaagccatgatagatgccgtcgttcagcaggcgtgggttcaaatggttgcccgctacggtaagccgaatcacctgaacgaacgcgaagggcgtggttttgcggtggtcggctacggcaagctgggcggctgggagttaggctacagttccgatcttgaccttatcttcctccatgattgcccaatggatgcgatgactgacggtgagcgggaaatcgacgggcggcagttttatctgcgtctggcgcaacgcattatgcatctgttcagtacgcgtacctcttccggcattttgtatgaagtggatgctcgactgcgtccgtccggggcggcgggaatgctggtgacatccgcagaagcatttgccgattatcagaaaaacgaggcctggacgtgggaacatcaggcgctggtgcgtgcgcgtgtagtgtacggcgatccgcagctcaccgcgcactttgacgcagtgcgtcgcgagattatgacgctgccgcgtgaaggtaaaactctgcaaacggaagtgcgggaaatgcgcgagaaaatgcgcgctcatctcggcaataaacatcgcgatcgctttgatatcaaagctgatgaagggggaattaccgatatcgaatttattacccaatatctggtgttgcgctacgctcatgaaaaaccgaagttaacgcgctggtcagacaacgtgcgtattctggaactactggcgcaaaacgacattatggaagagcaggaagcgatggcgctgacccgtgcttacactacgcttcgcgatgaacttcatcatctggcattacaggaattgccgggccatgtgtcggaggattgcttcaccgcagagcgtgaactggtgcgggcaagctggcagaagtggctggtggaagaatga

SEQ ID NO: 167 - DNA, 1302 bp, E. Coli
atggctcaggaaatcgaattaaagtttattgttaatcacagtgccgttgaggcgttgcgtgaccatctcaatacgctgggcggcgagcaccatgaccccgtgcagttgctgaatatttactacgaaacgccggataactggctgcgtgggcacgatatgggcttacgtattcgtggcgaaaacggtcgctatgagatgaccatgaaagttgcaggaagagtgacaggcggcttacatcagcgcccggaatataacgtggcgttgagcgaaccgacgctcgacctggcgcagttaccgacggaagtctggccgaacggcgaattgcccgccgatctcgcctcccgcgtgcagccgctgttcagcaccgatttttatcgcgaaaaatggctggtggcggtcgatggtagccaaattgaaatcgccctcgaccagggggaagtgaaagcgggtgaatttgctgaacctatctgtgagctggaactggaactgcttagcggcgacacgcgcgcggtgctgaaactggcgaaccaactggtatcgcaaaccggattacgccagggcagcctgagcaaagcggcgcgtggctatcatctggcgcagggcaatccggcgcgtgaaatcaaaccgaccaccattttgcatgttgcggcaaaagccgatgtggaacaggggctggaagcggcgctcgagctggcgttagcgcaatggcagtatcatgaagaactgtgggtacgcggcaacgatgcggcgaaagaacaggtgctggcagccattagcctggtccgtcatacgctgatgctgttcggtggtattgtgccgcgtaaagcgagcactcacttacgtgatctgctgactcaatgcgaggcgaccattgcttctgcggtgtctgccgtgacggcggtctactctaccgaaacggcaatggcgaagctggcgttgaccgaatggttggtaagcaaagcatggcagccatttttagatgccaaagcgcagggcaaaatcagcgactccttcaaacgctttgccgatatccatctttcccgccatgccgctgaactgaaaagcgttttctgccagccgttaggcgatcgctaccgtgaccagttgccacgcctgacgcgtgatattgactcaatactgttgctggcgggttactatgatcctgtcgtcgcgcaagcctggctggagaactggcaggggctgcatcacgctattgcgaccgggcaacgcatcgaaattgaacatttccgtaatgaggcaaacaatcaggaaccgttctggttgcacagcggaaaacgttaa

SEQ ID NO: 168 - DNA, 213 bp, E. Coli
atgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaa

SEQ ID NO: 169 - DNA, 1572 bp, E. Coli
atgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccggcgaaaatctttcaattagatgattctcaagggccggaaaaaataaaattattttcaatgctaaatcatgaaaaaggtctatactatttgacccgtgatttgcagtgttctattgatccccataattacctttttattcttgtttgcgcaaataacgcatggcaaaacattcctgccgagcggcttcgctcatggttggataaaatgaataaatggagcaggttaaaccattgttcgcttttggtaattaatcccggaaataataacgataaacaattttcattgttgcttgaggaataccgttcactttttggtcttgccagtttgcgttttcagggtgaccaacatttgctggatattgccttctggtgcaacgaaaaaggggtcagcgcccgtcagcagcttagcgttcagcaacaaaatggtatctggacattagttcaaagcgaagaggcggagatccaaccacgcagcgacgaaaaacgcattctgagtaatgttgctgtactggaaggtgcgccgccgctatcggaacactggcaactgttcaacaataacgaagtcctgttcaatgaagcccgtaccgctcaggcggcgacggtggtcttttctttacagcaaaatgcgcaaatcgagccactggcccgcagcattcataccctgcgtcgccagcgcggtagtgcgatgaaaatcctcgtgcgggaaaataccgctagcctgcgcgccaccgatgaacgtttgttattggcctgcggtgcaaatatggttattccgtggaatgcgccactctcccgttgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgaacaagccctgacgctgtgtcgccctaaccgtaccggcgatatcatgaccattggcggtaatcggctggtgctgtttctctcattctgtcggattaacgatctggataccgcgttgaatcatattttcccattgcctactggcgacattttctcaaaccgtatggtctggtttgaagatgatcaaatcagtgccgagctggtgcagatgcgcttgcttgccccagaacaatggggcatgccgctgcctttaacgcaaagttctaaaccggtcatcaatgccgagcacgatggtcgccactggcgacgaataccagaacccatgcgactgttagatgatgctgtggagcgctcatcatga

SEQ ID NO: 170 - DNA, 189 bp, E. Coli
atgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatga

SEQ ID NO: 171 - DNA, 1680 bp, E. Coli
atgactcaatttacgcaaaataccgccatgccttcttccctctggcaatactggcgcggcctttccggctggaacttctattttctggttaagttcggcctgttgtgggcgggatatcttaacttccatccgctcctcaatttggtgtttgccgcgtttctgctgatgccccttccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgaccttgtcacacgctttattaactggcagatgattggggccatttttgttttattagtggcctggttattcctgtcacaatggattcgcattaccgtttttgtggttgccatactgctatggctgaacgtacttaccctggcgggaccaagtttctccttgtggccagccggacaaccgacgaccactgtaacaacgacgggtggtaacgcagcggcaaccgttgcggcgacgggtggcgcaccggtagtgggtgatatgcccgcacaaactgcaccgccaacaacggcgaaccttaacgcctggctgaataatttctataacgcggaggcgaaacgtaaatcgaccttcccgtcttcgctgcccgctgatgctcagccatttgaactactggtgattaacatctgttcgctttcctggtcggatatagaagccgccgggttgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctttcgaaactgggctttacccagcacctgatgatgggacataacggccagttcggcggttttttgaaagaagttcgcgaaaatggcggcatgcagagcgaattgatggatcaaacaaatctgccggttattttgctgggctttgatggttcgccggtttatgacgataccgctgtgcttaaccgctggctggacgttaccgaaaaagataaaaacagccgtagtgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaa

SEQ ID NO: 172 - DNA, 384 bp, E. Coli
atggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgccgataagattgccaaacgcgaacggaaactggcagaagcgcaggaagagctgaaaaagctggaagcgcgcgactactaa

SEQ ID NO: 173 - DNA, 306 bp, E. Coli
atgtcgaaagaacacactacggaacatctgcgtgctgagttgaaatccctttccgatacgctggaagaggtgcttagctcatctggcgagaagtcgaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgcgaaaatccgtggacgggcgtgggcattggcgctgcaatcggtgtagtgctcggcgttctgctgtcgcgtcgttaa

SEQ ID NO: 174 - DNA, 405 bp, E. Coli
atggcggacactcatcacgcacaagggcccggtaaaagcgttctgggcatcgggcagcgaattgtttctatcatggttgaaatggtagagacacgtctgcggctggcggtggtggagctggaagaggaaaaagcgaatctctttcaacttttactgatgctgggcctgacgatgcttttcgctgcatttggtcttatgagcctgatggtgctaattatttgggcggttgacccgcaatatcgcctgaatgcgatgattgccaccaccgtggtgttgctgctactggcactgattggcggtatctggacgctacgtaaatcgcgtaagtctacgttgctgcgccatacacgccatgagttagcaaacgatcggcagctgctcgaggaggagtcccgtgagcagtaa

SEQ ID NO: 175 - DNA, 300 bp, E. Coli
gtgagcagtaaagtcgaacgtgaacgacgtaaggcgcaactgcttagccagatccagcaacaacggctggatctttccgccagtcgtcgtgaatggctggagacaacaggcgcttacgatcgtcgctggaatatgctgctaagtctgcgctcctgggcgctggttggcagtagcgtgatggcgatctggacgattcgccatcctaatatgctggtccgctgggccagacgcggttttggcgtatggagcgcctggcgtctggttaaaacgaccctcaagcagcaacagcttcgcggttaa

SEQ ID NO: 176 - DNA, 483 bp, E. Coli
atgattctctccatcgacagcaacgacgctaataccgcgccattgcacaaaaaaacaatcagcagcctgagtggcgcagtggagagtatgatgaaaaaattagaagatgttggtgtactggtagcgcgcattttaatgccgattctgtttattaccgctggctggggaaaaattactggctacgcgggtacccaacaatatatggaagcaatgggcgtcccgggttttatgctgccactggtgattctgcttgagtttggtggtggtctggcaatcctgttcggtttcctgactcgcaccacagccctgtttactgcgggctttacgctgctgacggcatttttatttcacagcaactttgctgaaggcgtcaactcgctgatgttcatgaaaaacctgacaatttctggcggattcctgctgctggcaattaccggtccgggcgcgtatagcatcgaccgcctgctgaataaaaagtggtaa

SEQ ID NO: 177 - DNA, 891 bp, E. Coli
atgatcaagaagacaacggaaattgatgccatcttgttaaatctcaataaggctatcgatgcccactaccagtggctggtgagtatgtttcacagcgtggtcgcgagagatgccagtaagccagaaataacggataaccattcttatggactgtgccagtttggtcggtggattgatcatctggggccactcgataacgatgaattaccttacgttcggctaatggattctgcccatcaacatatgcataactgtggtcgggaattaatgctggctattgttgaaaatcactggcaggacgcgcatttcgacgcctttcaggaggggttgctttcttttactgcggcattaaccgattacaaaatttatttgctgacgatccgtagcaatatggatgttttgacgggattgccgggtcgtcgggttcttgatgaatcctttgatcatcagttacgcaacgctgagcctctgaatctttatttaatgttgttggatattgaccgatttaaattggttaatgatacctacgggcatttaatcggcgatgtagtattacgcaccctggcaacttacttagccagttggacgcgtgattacgaaacggtttatcgctacgggggcgaagaatttatcattattgtcaaagcggctaatgatgaagaagcatgtcgtgcaggtgtcagaatttgccagttagtcgataaccatgccatcacacattctgaagggcatatcaacattaccgtgacagcaggtgtgagtcgcgcatttcctgaagagcctctggatgtggtcattggaagagcggaccgggcaatgtatgagggtaagcaaaccggaagaaatcgctgcatgtttattgacgaacaaaatgtgattaaccgagtttaa

SEQ ID NO: 178 - DNA, 612 bp, E. Coli
atgcgccttcgtgttgtgcccggttttatttcaccacctccgggcttcggtggtctcggctatacccctacagcgagagcttgtgttaacatttcaatacccttacagttgagagttattgatatgttggatgtatttactccattgttgaaactttttgctaacgagccactcgaaagacttatgtatacgattatcatttttggtctcactctctggctgataccgaaagagtttactgtcgcattcaatgcttatactgaaataccttggctctttcagattatcgtttttgccttttctttcgtggtcgccatttccttctcaagattgcgagcacatattcaaaagcattattcattactaccagagcaacgagtattgcttcgtttatctgagaaagaaatcgctgtatttaaagatttccttaaaacaggaaatcttattatcacttctccttgccgtaacccggttatgaaaaaattagaacggaagggcatcattcaacatcagagtgatagcgcaaactgttcttattatctcgtcaccgaaaaatactcccattttatgaagttattctggaacagcaggagtagacgttttaatcgttag

SEQ ID NO: 179 - DNA, 177 bp, E. Coli
gtgcttctccaaccatcggcgcgcaccagtttcggttttaaatgttttgcttttggtatacgtcatggcagtgaacgttccatcctggttggggaacacgccgcacaccagggattcgttgttgccgaggtcgattttttgcattttgcgaatctcacatcttgttgctacgtatag

SEQ ID NO: 180 - DNA, 4281 bp, E. Coli
atgagcggaaaaccagcggcgcgtcagggagatatgactcagtatggcggtcccattgtccagggttcggcaggtgtaagaattggcgcgcccaccggcgtggcgtgctcggtgtgtccgggcgggatgacttcgggcaacccggtaaatccgctgctgggggcgaaggtgctgcccggcgagacggaccttgcgctgcccggcccgctgccgttcattctctcccgcacctacagcagctaccggacgaagacgcctgcaccggtgggcgttttcggccccggctggaaagcgccttctgatatccgcttacagctacgtgatgacggactgatactcaacgacaacggcgggcggagcattcactttgagccgctgctgccgggggaggcggtgtacagccgcagtgagtcaatgtggctggtgcgcggtggtaaggcagcacagccggacggccatacgctggcgcggctgtggggggcgctgccgccggatatccggttaagcccgcatctttacctggcgaccaacagcgcacaggggccgtggtggatactggggtggtctgagcgggtgccgggtgctgaggacgtactgccagcgccgctgccgccgtaccgggtgcttaccgggatggcggaccgcttcgggcggacgctgacgtaccggcgtgaggccgccggtgacctggccggggaaatcaccggcgtgacggacggtgccgggcgggagttccgtctggtgctgaccacgcaggcgcagcgtgcggaagaggcccgcacctcttcgctatcttcttctgacagttcccgccctctctcagcctcagcgttccccgacacactgcccggtaccgaatacggccccgacaggggtatccgcctttcggcggtgtggctgatgcacgacccggcatacccggagagcctgcccgctgcgccactggtgcggtacacgtatacggaagccggtgaactgctggcggtatatgaccgcagcaatacgcaggtgcgcgctttcacgtatgacgcgcagcacccgggccggatggtggcgcaccgttacgcgggaaggccggagatgcgctaccgctacgacgatacggggcgggtggtggagcaactgaacccggcagggttaagctaccgctatctttatgagcaggaccgcatcaccgtcaccgacagcctgaaccggcgtgaggtgctgcatacagaaggcggggccgggctgaaacgggtggtgaaaaaagaactggcggacggcagcgtcacgcgcagcgggtatgacgcggcaggaaggctcacggcgcagacggacgcggcgggacggaggacagagtacggtctgaatgtggtgtccggcgatatcacggacatcaccacaccggacgggcgggagacgaaattttactataacgacgggaaccagctgacggcggtggtgtccccggacgggctggagagccgccgggaatatgatgaaccgggcaggctggtatcggagacatcgcgcagcggggagacagtacgctaccgctacgatgacgcgcacagtgagttaccggcgacgacaacggatgcgacgggcagcacccggcagatgacctggagccgctacgggcagttgctggcgttcaccgactgctcgggctaccagacccgttatgaatacgaccgcttcggccagatgacggcggtccaccgcgaggaaggcatcagcctttaccgccgctatgacaaccgtggccggttaacctcggtgaaagacgcacagggccgtgaaacgcggtatgaatacaacgccgcaggcgacctgactgccgttatcaccccggacggcaaccggagcgagacacagtacgatgcgtggggaaaggcggtcagcaccacgcagggcgggctgacgcgcagtatggagtacgatgctgccggacgtgtcatcagcctgaccaacgagaacggcagccacagcgtcttcagttacgatgcgctggaccggctggtacagcagggcggctttgacgggcggacgcaacgttatcattatgacctgaccggaaaactcacacagagtgaggatgagggacttgtcatcctctggtactacgatgaatcggaccgtatcactcaccgcacggtgaacggcgaaccggcagagcagtggcagtatgatggccacggctggctgacagacatcagccacctgagcgaaggccaccgtgttgccgtccactatggctatgacgataaaggccgcctgaccggcgaatgccagacggtggagaacccggagacgggggaactgctgtggcagcatgagacgaaacacgcatacaacgagcaggggctggcaaaccgcgtcacgccggacagcctgccgccggtggagtggctgacgtatggcagcggttacctggcgggaatgaagctgggcgggacgccgctggtcgagtatacgcgggacaggctgcaccgtgagacggtgcgcagcttcggcagcatggcaggcagtaatgccgcatacgaactgaccagcacatacacccccgcaggccagttacagagccagcacctgaacagcctggtatatgaccgtgactacgggtggagtgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagctcatctttatcactgcgaccaccggggactgccgctggcgcttatcagcgaagacggcaatacggcgtggagcgcggaatatgatgaatggggcaaccagcttaatgaggagaacccgcatcatgtgtatcagccgtaccgtctgccagggcagcagcatgatgaggaatcagggctgtactataaccgtcaccggtactacgatccgttgcaggggcggtatattactcaggacccgatggggttgaaagggggatggaatttatatcagtatcctttaaatccactacaacaaattgaccctatgggattattgcagacttgggatgatgccagatctggagcatgtacggggggagtttgtggtgttctttcacgtataataggaccaagtaaatttgatagtactgcagatgctgcgttagatgctttgaaagaaacgcagaatagatctctatgtaatgatatggaatactctggtattgtctgtaaagatactaatggaaaatattttgcatctaaggcagaaactgataatttaagaaaggagtcatatcctctgaaaagaaaatgtcccacaggtacagatagagttgctgcttatcatactcacggtgcagatagtcatggcgattatgttgatgaatttttttcaagtagcgataaaaatcttgtaagaagtaaagataataatcttgaagcattttatctcgcaacacctgatggacgatttgaggcgcttaataataaaggagaatatatttttatcagaaatagtgtcccgggattgagttcagtatgcataccgtatcatgattaa

SEQ ID NO: 181 - DNA, 369 bp, E. Coli
atgaaatatagttcaatattttcgatgctttcattttttatactatttgcctgtaatgagacagctgtttacggttctgatgaaaacattatttttatgaggtatgtggaaaaattacatttagataaatactctgttaaaaatacggtaaaaactgaaacaatggcgatacaattagctgaaatatatgttaggtatcgctatggcgaacggattgcagaagaagaaaaaccatatttaattacggaactaccagatagttgggttgttgagggagcaaagttaccttatgaagttgcgggtggtgtatttattatagaaattaataagaaaaatggatgtgttttgaatttcctacatagtaaataa

SEQ ID NO: 182 - DNA, 711 bp, E. Coli
atgctggcgctgatggatgcggatggaaacattgcgtggagcggggagtatgatgagtggggcaaccagctgaatgaagagaacccgcatcacctgcaccagccgtaccggctgccggggcagcagtatgataaggagtcggggctgtactacaaccggaaccggtactacgatccgttgcaggggcggtatatcactcaggacccgatagggctggaggggggatggagtctgtatgcgtatccgctgaatccggtgaatggtattgatccattagggttaagtcccgcagatgtagcgctaataagaagaaaagatcaactaaaccatcaaagagcatgggatatattatctgatacttatgaagatatgaagagattaaatttaggtgggactgatcaatttttccattgtatggcattttgtcgagtgtctaaattaaatgacgctggtgttagccgatcggcgaaagggctgggttatgaaaaagagattagagattacgggttaaatctgttcggtatgtacggcagaaaagtaaagctatcccattctgaaatgattgaagataataaaaaagacttggctgtaaatgaccatgggttgacatgtccatcaacaacagattgctcagatagatgtagtgattatattaatccagagcataaaaaaacgataaaggctttacaagatgctggctatctcaagtaa

SEQ ID NO: 183 - DNA, 261 bp, E. Coli
atgctggctatctcaagtaatctatcaaagatgataatatttatttttgctattataatcattgttgttttatgcgtaattacttatctttatttatacaaagatgaatctcttgtaagtaaacattacataaactatatggcaataccagaaaatgatggagtttttacatggctcccagatttttttccgcacgtagcggtggatatatcaatatacacaaatgtagaagatgattatttttttcttatttttccctaa

SEQ ID NO: 184 - DNA, 192 bp, E. Coli
gtgagggccagggaacaagtggcgaaaatcgtatcaaagaatgatccagatacaaaaaaagtgtggtgtaaatatggtaagataccagggcaaggggatggtgtaaaccttttttttgttggtgaaattaatgttacgcattattttataacaaatattggagctggattgcctgatgcttgtgcagagtaa

SEQ ID NO: 185 - DNA, 504 bp, E. Coli
atgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 186 - DNA, 276 bp, E. Coli
gtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaa

SEQ ID NO: 187 - DNA, 417 bp, E. Coli
atgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggattatagcatttcaatatttacttatgacattaaaggtgatgctgccaacttactgatttag

SEQ ID NO: 188 - DNA, 1179 bp, E. Coli
atgagtaatattgtttacctgacagtaacgggagaacaacaaggaagcatctccgcaggttgtgggacttctgagtctacaggtaatcgttggcagagcgggcatgaggatgaaatatttacattctcactcttaaataatattaataatacggggcttggttcacagttccatggtataacattttgtaaattaattgataaaagcactccattatttattaattccattaacaataatgaacaattatttatgggatttgacttctatcgaataaatagatttggtagattggaaaagtattattatatacaactaagaggcgcttttttatcggctattcatcaccagatcattgaaaaccaactggatacagaaacaataactattagttatgaatttatcctctgtcaacatcttatcgcaaataccgagttcagctatttggcactccctgaaaattataaccgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttctaatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctggaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatgcaatcacgaatagctaagggaatattagtaggtgaaagcaaaatcactccctgggccattccatctggctcaatttatcctcccatgaaaaatattatggaccacacaaaatga

SEQ ID NO: 189 - DNA, 666 bp, E. Coli
atggtacttgctttgaactataatatgcacggagttaatattcgctcagagaatgcagcaaaacctcatacgatgccctctagatatctttgcgagtatattagaagcattgagaaaaatggccacgcccttgattttggctgcggaaaacttagatattctgatgaattaatcagtaaatttgatgaagttacttttctagactcgaaaaggcaacttgaaagagagcaaattattagaggaattaaaactaaaattattgactatgtcccacgatattataaaaatgcaaatacagttgctttcgaggatgtcgacaaaataattgggggttacgatttcatcctttgctctaatgttctctctgccgttccttgtcgggatacaatcgacaaaatagttcttagcatcaagagattactaaaatcaggaggtgagactcttattgtaaatcaatataaaagctcatacttcaaaaaatacgaaacaggaagaaaacatctttacggatacatttacaaaaattcaaaaagtgtttcttactatggattactcgatgaactcgcagtgcaagaaatatgttcttcacatggccttgaaatattaaagtcgtggagtaaagcaggaagttcatatgtcactgttgggagttgtaatgcaatataa

SEQ ID NO: 190 - DNA, 705 bp, E. Coli
gtgaataatatgttcgaaccccccaaaaattataatgaaatgttgcctaaacttcataaagcaactttcttaaatacgctaatatattgcatacttctagttatttacgaatacatccctttaataacattaccaaccaagtatgtcccacctattaaagatcatgagagctttattaattgggcactatcttttggtatattaccttgtgcttttgcgatttttgcatatttaattagcggtgcgttagacctacataacaatgcagccaaactacttcgggtgcgatatctttgggataagcatctaattataaaaccgttatcacggagagctggagtcaacagaaaattaaataaagatgaagctcacaatgtaatgagcaatctatattaccctgaagtaagaaaaattgaagacaaacattatattgaactcttctggaataaagtatactatttttggatattttttgaattttcgataattgcattaatttccttcctaataatctttttttgcaaacaaatggatatttttcatgttgaaggttctttgctgtctttattcttttttgtaattttatcattctcagtgagtggtattatctttgctttgacagttaagcccagaactgaaagtcaagtcggaaaaatcccggacgataaaataaaagaatttttcactaaaaataacattaattga

SEQ ID NO: 191 - DNA, 285 bp, E. Coli
atgtttactatcaacgcagaagtacgtaaagagcagggtaagggtgcgagccgccgcctgcgtgccgctaacaagttcccggcaatcatctacggtggcaaagaagcgccgctggctatcgagctggatcacgacaaagtcatgaacatgcaagctaaagctgaattctacagcgaagttctgaccatcgttgttgacggtaaagaaatcaaagttaaagctcaggacgtacagcgtcacccgtacaaaccgaagctgcagcacatcgacttcgttcgcgcttaa

SEQ ID NO: 192 - DNA, 1977 bp, E. Coli
atggtattgttttatcgggcacactggcgcgactataaaaacgatcaagtgaggatcatgatgaatctgacgactctgacccaccgcgatgcgttgtgtctgaatgcgcgctttaccagccgtgaagaggccatccacgcgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataa

SEQ ID NO: 193 - DNA, 2634 bp, E. Coli
atgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgcccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggctgcgcgccagccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctatgggctatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtaggggtggtgttggttgtcactcttagtcataacagcaggcgtattgatgtggatatcaatcttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgtgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctga

SEQ ID NO: 194 - DNA, 1572 bp, E. Coli
atgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaa

SEQ ID NO: 195 - DNA, 1140 bp, E. Coli
atgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaa

SEQ ID NO: 196 - DNA, 1371 bp, E. Coli
atggaattatcctcactgaccgccgtttcccctgtcgatggacgctacggcgataaagtcagcgcgctgcgcgggattttcagcgaatatggtttgctgaaattccgtgtacaagttgaagtacgttggctgcaaaaactggccgcgcacgcagcgatcaaggaagttcctgcttttgctgccgacgcaatcggttaccttgatgcaatcgtcgccagtttcagcgaagaagatgcggcgcgcatcaaaactatcgagcgtaccactaaccacgacgttaaagcggttgagtatttcctgaaagaaaaagtggcggagatcccggaactgcacgcggtttctgaattcatccactttgcctgtacttcggaagatatcaataacctctcccacgcattaatgctgaaaaccgcgcgtgatgaagtgatcctgccatactggcgtcaactgattgatggcattaaagatctcgccgttcagtatcgcgatatcccgctgctgtctcgtacccacggtcagccagccacgccgtcaaccatcggtaaagagatggcaaacgtcgcctaccgtatggagcgccagtaccgccagcttaaccaggtggagatcctcggcaaaatcaacggcgcggtcggtaactataacgcccacatcgccgcttacccggaagttgactggcatcagttcagcgaagagttcgtcacctcgctgggtattcagtggaacccgtacaccacccagatcgaaccgcacgactacattgccgaactgtttgattgcgttgcgcgcttcaacactattctgatcgactttgaccgtgacgtctggggttatatcgcccttaaccacttcaaacagaaaaccattgctggtgagattggttcttccaccatgccgcataaagttaacccgatcgacttcgaaaactccgaagggaatctgggcctttccaacgcggtattgcagcatctggcaagcaaactgccggtttcccgctggcagcgtgacctgaccgactctaccgtgctgcgtaacctcggcgtgggtatcggttatgccttgattgcatatcaatccaccctgaaaggcgtgagcaaactggaagtgaaccgtgaccatctgctggatgaactggatcacaactgggaagtgctggctgaaccaatccagacagttatgcgtcgctatggcatcgaaaaaccgtacgagaagctgaaagagctgactcgcggtaagcgcgttgacgccgaaggcatgaagcagtttatcgatggtctggcgttgccagaagaagagaaagcccgcctgaaagcgatgacgccggctaactatattggtcgagctatcacgatggttgatgagctgaaataa

SEQ ID NO: 197 - DNA, 186 bp, E. Coli
atgctgattctgactcgtcgagttggtgagaccctcatgattggggatgaggtcaccgtgacagttttaggggtaaagggcaaccaggtacgtattggcgtaaatgccccgaaggaagtttctgttcaccgtgaagagatctaccagcgtatccaggctgaaaaatcccagcagtccagttactaa

SEQ ID NO: 198 - DNA, 93 bp, E. Coli
ggtgaggtggccgagaggctgaaggcgctcccctgctaagggagtatgcggtcaaaagctgcatccggggttcgaatccccgcctcaccgcca

SEQ ID NO: 199 - DNA, 603 bp, E. Coli
atgaagaataaggctgataacaaaaaaaggaacttcctgacccatagtgaaatcgaatcactccttaaagcagcaaataccgggcctcatgcagcacgtaattattgtctgactttgctttgttttattcatggtttccgggcgagtgaaatttgtcgattgaggatttcggatattgatcttaaggcaaagtgtatatatatccatcgattaaaaaaaggcttttcaacaacgcacccgctattgaataaagaagttcaggctttaaaaaactggttgagtatccgtacttcgtacccgcatgctgagagcgagtgggtatttttatcacgtaaggggaatccgctttctcggcaacagttttaccatattatctcgacttccggtggtaatgccgggttgtcactggagattcatccgcacatgttacgccattcgtgtggttttgctttggcgaatatgggaatagatacgcgacttatccaggattatcttgggcatcgcaatattcgtcatactgtctggtataccgccagcaatgcagggcgtttttacggcatctgggatagagccagaggacgacagcgtcacgctgttttatag

SEQ ID NO: 200 - DNA, 597 bp, E. Coli
gtgagtaaacgtcgttatcttaccggtaaagaagttcaggccatgatgcaggcggtttgttacggggcaacgggagccagagattattgtcttattctgttggcatatcggcatgggatgcgtattagtgaactgcttgatctgcattatcaggaccttgaccttaatgaaggtagaataaatattcgccgactgaagaacggattttctaccgttcacccgttacgttttgatgagcgtgaagccgtggaacgctggacccaggaacgtgctaactggaaaggcgctgaccggactgacgctatatttatttctcgccgcgggagtcggctttctcgccagcaggcctatcgcattattcgcgatgccggtattgaagctggaaccgtaacgcagactcatcctcatatgttaaggcatgcttgcggttatgaattggcggagcgtggtgcagatactcgtttaattcaggattatctcgggcatcgaaatattcgccatactgtgcgttataccgccagtaatgctgctcgttttgccggattatgggaaagaaataatctcataaacgaaaaattaaaaagagaagaggtttga

SEQ ID NO: 201 - DNA, 549 bp, E. Coli
atgaaaattaaaactctggcaatcgttgttctgtcggctctgtccctcagttctacagcggctctggccgctgccacgacggttaatggtgggaccgttcactttaaaggggaagttgttaacgccgcttgcgcagttgatgcaggctctgttgatcaaaccgttcagttaggacaggttcgtaccgcatcgctggcacaggaaggagcaaccagttctgctgtcggttttaacattcagctgaatgattgcgataccaatgttgcatctaaagccgctgttgcctttttaggtacggcgattgatgcgggtcataccaacgttctggctctgcagagttcagctgcgggtagcgcaacaaacgttggtgtgcagatcctggacagaacgggtgctgcgctgacgctggatggtgcgacatttagttcagaaacaaccctgaataacggaaccaataccattccgttccaggcgcgttattttgcaaccggggccgcaaccccgggtgctgctaatgcggatgcgaccttcaaggttcagtatcaataa

SEQ ID NO: 202 - DNA, 648 bp, E. Coli
gtgctgctaatgcggatgcgaccttcaaggttcagtatcaataacctacccaggttcagggacgtcattacgggcagggatgcccacccttgtgcgataaaaataacgatgaaaaggaagagattatttctattagcgtcgttgctgccaatgtttgctctggccggaaataaatggaataccacgttgcccggcggaaatatgcaatttcagggcgtcattattgcggaaacttgccggattgaagccggtgataaacaaatgacggtcaatatggggcaaatcagcagtaaccggtttcatgcggttggggaagatagcgcaccggtgccttttgttattcatttacgggaatgtagcacggtggtgagtgaacgtgtaggtgtggcgtttcacggtgtcgcggatggtaaaaatccggatgtgctttccgtgggagaggggccagggatagccaccaatattggcgtagcgttgtttgatgatgaaggaaacctcgtaccgattaatcgtcctccagcaaactggaaacggctttattcaggctctacttcgctacatttcatcgccaaatatcgtgctaccgggcgtcgggttactggcggcatcgccaatgcccaggcctggttctctttaacctatcagtaa

SEQ ID NO: 203 - DNA, 726 bp, E. Coli
gtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagagcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgcccggctaaattagcgttgccacccgatcaggccgcagaaaaattaagatttcgtcgtagcgcgaattctctgacgctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataa

SEQ ID NO: 204 - DNA, 2637 bp, E. Coli
atgtcatatctgaatttaagactttaccagcgaaacacacaatgcttgcatattcgtaagcatcgtttggctggtttttttgtccgactcgttgtcgcctgtgcttttgccgcacaggcacctttgtcatctgccgacctctattttaatccgcgctttttagcggatgatccccaggctgtggccgatttatcgcgttttgaaaatgggcaagaattaccgccagggacgtatcgcgtcgatatctatttgaataatggttatatggcaacgcgtgatgtcacatttaatacgggcgacagtgaacaagggattgttccctgcctgacacgcgcgcaactcgccagtatggggctgaatacggcttctgtcgccggtatgaatctgctggcggatgatgcctgtgtgccattaaccacaatggtccaggacgctactgcgcatctggatgttggtcagcagcgactgaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataacagtagcgacagatcatcaggtagcaaaaataaatggcagcatatcaatacctggcttgagcgagacataataccgttacgttcccggctgacgctgggtgatggttatactcagggcgatattttcgatggtattaactttcgcggcgcacaattggcctcagatgacaatatgttacccgatagtcaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgatcaaagaggctgacggcagcacgcagatttttaccgtaccctattcgtcagtcccgcttttgcaacgtgaagggcatactcgttattccattacggcaggagaataccgtagtggaaatgcgcagcaggaaaaaacccgctttttccagagtacattactccacggccttccggctggctggacaatatatggtggaacgcaactggcggatcgttatcgtgcttttaatttcggtatcgggaaaaacatgggggcactgggcgctctgtctgtggatatgacgcaggctaattccacacttcccgatgacagtcagcatgacggacaatcggtgcgttttctctataacaaatcgctcaatgaatcaggcacgaatattcagttagtgggttaccgttattcgaccagcggatattttaatttcgctgatacaacatacagtcgaatgaatggctacaacattgaaacacaggacggagttattcaggttaagccgaaattcaccgactattacaacctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatatcaactggacgctcagctatagcctgacgaaaaacgcctggcaaaaaggacgggatcagatgttagcgcttaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacgggggtgcgtaccgactggcgtggttatgccgtgctgccttatgccactgaatatcgggaaaatagagtggcgctggataccaataccctggctgataacgtcgatttagataacgcggttgctaacgttgttcccactcgtggggcgatcgtgcgagcagagtttaaagcgcgcgttgggataaaactgctcatgacgctgacccacaataataagccgctgccgtttggggcgatggtgacatcagagagtagccagagtagcggcattgttgcggataatggtcaggtttacctcagcggaatgcctttagcgggaaaagttcaggtgaaatggggagaagaggaaaatgctcactgtgtcgccaattatcaactgccaccagagagtcagcagcagttattaacccagctatcagctgaatgtcgttaa

SEQ ID NO: 205 - DNA, 531 bp, E. Coli
atgagaaacaaacctttttatcttctgtgcgcttttttgtggctggcggtgagtcacgctttggctgcggatagcacgattactatccgcggctatgtcagggataacggctgtagtgtggccgctgaatcaaccaattttactgttgatctgatggaaaacgcggcgaagcaatttaacaacattggcgcgacgactcctgttgttccatttcgtattttgctgtcaccctgtggtaatgccgtttctgccgtaaaggttgggtttactggcgttgcagatagccacaatgccaacctgcttgcacttgaaaatacggtgtcagcggcttcgggactgggaatacagcttctgaatgagcagcaaaatcaaataccccttaatgctccatcgtccgcgctttcgtggacgaccctgacgccgggtaaaccaaatacgctgaatttttacgcccggctaatggcgacacaggtgcctgtcactgcggggcatatcaatgccacggctaccttcactcttgaatatcagtaa

SEQ ID NO: 206 - DNA, 504 bp, E. Coli
atgaaatggtgcaaacgtgggtatgtattggcggcaatattggcgctcgcaagtgcgacgatacaggcagccgatgtcaccatcacggtgaacggtaaggtcgtcgccaaaccgtgtacggtttccaccaccaatgccacggttgatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacagtaaatggcggagccactcagggaaccattcaggcagtgattagcatcacctatacctacagctga

SEQ ID NO: 207 - DNA, 903 bp, E. Coli
atgaaacgagttattaccctgtttgctgtactgctgatgggctggtcggtaaatgcctggtcattcgcctgtaaaaccgccaatggtaccgctatccctattggcggtggcagcgccaatgtttatgtaaaccttgcgcccgtcgtgaatgtggggcaaaacctggtcgtggatctttcgacgcaaatcttttgccataacgattatccggaaaccattacagactatgtcacactgcaacgaggctcggcttatggcggcgtgttatctaatttttccgggaccgtaaaatatagtggcagtagctatccatttcctaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtgagtctgggattaacggcaaattatgcacgtaccggagggcaggtgactgcagggaatgtgcaatcgattattggcgtgacttttgtttatcaataa

SEQ ID NO: 208 - DNA, 1631 bp, E. Coli
gtgctgtcaaaactaccccgtagactccgatcttttcaaacatattgcaccatccgtgtacatcggggtgaggatatgaaatcaatggataagttaacaacaggtgttgcctatggcacatcggcgggtaatgctggtttctgggcattgcagttactcgataaagtaactccgtcacagtgggctgcaatcggtgtgctgggtagcctggtttttggcctgctgacgtatctgacaaatctttatttcaagattaaagaagacaggcgtaaggctgcgagaggagagtaatccaatgactcaagactatgaactggttgtgaaaggagtccgtaattttgagaataaagttacggtaactgtagccttacaggacaaagaacgctttgacggtgaaatttttgacctggatgtcgccatggaccgtgttgaaggagctgcgctggagttttatgaggcagcagccagaaggagcgtccggcaagtcttcctggaagtagcagaaaaattgtcagaaaaagttgagtcttatctgcagcatcagtactcctttaagattgaaaatcctgccaataagcacgagcgtcctcatcataaatatctatgaacacaaaaatcagatacggcctgtcggctgccgttctggcgctgattggtgctggcgcatctgctcctcagatacttgaccagtttctggacgaaaaagaaggtaaccacacaatggcataccgcgatggttctggcatatggaccatctgtcggggtgccacagtggtggatggaaaaaccgtttttcccaatatgaaactgtcgaaggaaaaatgcgaccaggtcaacgccattgagcgtgataaggcgctggcatgggtggagcgcaatattaaagtaccactgaccgaaccacaaaaagcgggtatcgcgtcattttgtccctataacattggccccggtaagtgtttcccgtcgacgttttataagcggctgaatgctggtgatcgtaaaggtgcatgcgaagcgattcgctggtggattaaggatggcggacgcgattgccgcattcgttcaaataactgttacggtcaggttattcgtcgtgaccaggagagcgcattaacctgctgggggatagaacagtgaatcagatattcatggtgatttttctcgtgttgtcaggatttatcgtcggaaatgtctggagcgaccgaggatggcaaaaaaaatgggcggaacgtgatgctgccgcattatcacaagaggtaaatgctcaatttgctgctcgaataattgaacaggggcgaactatagcccgtgatgaggctgttaaagatgcgcaacagaaatctgctgaaatttctgccagggctgcttatctgtctgatagtgttaaccagttgcgtgccgaagcaaaaaaatatgccatacgccttgacgcagcgaagcataccgcagatcttgccgctgccgtcagaggcaaaacaaccaaaaccgccgaaggaatgctcaccaacatgctcggagatattgcagcagaagctcagctttatgctgaaattgctgacgaacgctacatcgcaggagtgacttgtcaacagatctatgaatctttaagagataaaaagcatcaaatgtag

SEQ ID NO: 209 - DNA, 534 bp, E. Coli
atgaacacaaaaatcagatacggcctgtcggctgccgttctggcgctgattggtgctggcgcatctgctcctcagatacttgaccagtttctggacgaaaaagaaggtaaccacacaatggcataccgcgatggttctggcatatggaccatctgtcggggtgccacagtggtggatggaaaaaccgtttttcccaatatgaaactgtcgaaggaaaaatgcgaccaggtcaacgccattgagcgtgataaggcgctggcatgggtggagcgcaatattaaagtaccactgaccgaaccacaaaaagcgggtatcgcgtcattttgtccctataacattggccccggtaagtgtttcccgtcgacgttttataagcggctgaatgctggtgatcgtaaaggtgcatgcgaagcgattcgctggtggattaaggatggcggacgcgattgccgcattcgttcaaataactgttacggtcaggttattcgtcgtgaccaggagagcgcattaacctgctgggggatagaacagtga

SEQ ID NO: 210 - DNA, 312 bp, E. Coli
atgactcaagactatgaactggttgtgaaaggagtccgtaattttgagaataaagttacggtaactgtagccttacaggacaaagaacgctttgacggtgaaatttttgacctggatgtcgccatggaccgtgttgaaggagctgcgctggagttttatgaggcagcagccagaaggagcgtccggcaagtcttcctggaagtagcagaaaaattgtcagaaaaagttgagtcttatctgcagcatcagtactcctttaagattgaaaatcctgccaataagcacgagcgtcctcatcataaatatctatga

SEQ ID NO: 211 - DNA, 291 bp, E. Coli
gtgctgtcaaaactaccccgtagactccgatcttttcaaacatattgcaccatccgtgtacatcggggtgaggatatgaaatcaatggataagttaacaacaggtgttgcctatggcacatcggcgggtaatgctggtttctgggcattgcagttactcgataaagtaactccgtcacagtgggctgcaatcggtgtgctgggtagcctggtttttggcctgctgacgtatctgacaaatctttatttcaagattaaagaagacaggcgtaaggctgcgagaggagagtaa

SEQ ID NO: 212 - DNA, 216 bp, E. Coli
atgtcaaataaaatgactggtttagtaaaatggtttaacgctgataaaggtttcggctttatttctcctgttgatggtagtaaagatgtgtttgtgcatttttctgcgattcagaatgataattatcgaaccttatttgaaggtcaaaaggttaccttctctatagagagtggtgctaaaggtcctgcagcagcaaatgtcatcattactgattaa

SEQ ID NO: 213 - DNA, 1017 bp, E. Coli
atgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaa

SEQ ID NO: 214 - DNA, 474 bp, E. Coli
atggtatatataataatcgtttcccacggacatgaagactacatcaaaaaattactcgaaaatcttaatgctgacgatgagcactacaagattatcgtacgcgacaacaaagactctctattattgaaacaaatatgccagcattatgcaggcctggactatattagtggaggtgtatacggctttggtcataataataatattgcggtggcgtatgtaaaggaaaaatatagacccgcagatgatgattacattttgtttttgaatcccgatatcatcatgaagcatgatgatttgctgacatatattaaatatgtcgaaagtaagcgttatgcttttagtacattatgcctgttccgagatgaagcgaaatctttacatgattattccgtaagaaaatttcctgtgctttctgattttattgtgtcatttatgttagggattaaggaaggtgcgaacaagtccctgatatga

SEQ ID NO: 215 - DNA, 1119 bp, E. Coli
atgggaaaaagcatagtcgttgtttctgcggtcaattttaccactggcggtccatttaccattttgaaaaaatttttggcagcaactaataataaagaaaatgtcagttttatcgcattagtccattctgctaaagagttaaaagaaagttatccatgggttaaattcattgagtttcctgaggttaaagggtcgtggctaaaacgtttgcactttgaatatgtagtttgtaaaaaactttcaaaagagctgaatgctacgcattggatttgtctgcatgatattacggccaatgtcgtcactaaaaaaagatatgtgtattgtcataaccctgcacctttttataaaggaattttattccgtgaaattcttatggagcctagctttttcttatttaaaatgctatacgggctgatatataaaataaacattaaaaaaaatactgcagtgtttgttcaacaattctggatgaaagaaaaatttatcaagaaatattctataaataacatcattgtcagtcggccagaaattaaattatctgataaaagccaacttactgatgatgattctcaatttaagaataacccttctgagttgacaatattttaccctgctgttccacgagtatttaaaaattacgagcttattattagtgcagcaaggaaattgaaagaacaatccaatattaaatttctgcttactatcagtggtacagaaaatgcgtatgcaaaatatattatcagtcttgcagaaggactggataatgttcatttcctcgggtacttggataaagaaaaaatcgatcattgttataatatttcagatatagtttgttttccctctaggttagaaacatggggattgccgttgtctgaagctaaagagcgaggtaagtgggtattagcatcagatttcccatttactagagaaactcttggtagttatgaaaagaaagctttttttgattctaataacgatgacatgttagttaaacttattattgacttcaaaaaaggtaacctcaaaaaagatatctctgatgcaaatttcatttatcgtaatgaaaatgtattagttgggtttgatgaactagttaattttattactgaagaacattga

SEQ ID NO: 216 - DNA, 591 bp, E. Coli
atgatcttaaaactcgctaaacgatatggtctctgtggttttattcggcttgttagagatgtcttattgactcgtgtattttaccggaactgtagaattattcgatttccctgctatattcgcaatgatggtagcattaattttggtgaaaatttcacaagtggagtcggtctcaggctggatgcatttggacgtggcgtgatttttttttccgataatgtgcaagttaacgactatgttcatatcgcctcaattgagagcgttacgataggtcgggatacgcttattgcaagtaaagtatttattaccgatcataatcacggttcctttaagcactctgatccaatgagttcgccaaatatacctccagacatgcgcacgttggaatcttcagctgttgtaattggccagagggtttggttgggtgagaatgtgacggttttgcctggaacaattattggtaatggagtcgtagtcggcgccaattctgttgttagaggttctattcccgaaaatactgtcattgcgggagtaccagcaaaaatcataaagaaatacaatcatgagaccaaattatgggaaaaagcatag

SEQ ID NO: 217 - DNA, 993 bp, E. Coli
atgtattttttgaatgatttaaatttctctagacgcgatgctggatttaaagcaagaaaagatgcactggacattgcttcagattatgaaaacatttctgttgttaacattcctctatggggtggagtagtccagagaattattagttctgttaagcttagtacatttctctgcggtcttgaaaataaagatgttttaattttcaatttcccgatggccaaaccattttggcatatattgtcattctttcaccgccttctaaaatttagaatagtacctctgattcatgatattgatgaattaagaggaggagggggtagtgattctgtgcggcttgctacctgtgatatggtcataagtcacaatccacaaatgacaaagtaccttagtaaatatatgtctcaggataaaatcaaagacataaaaatatttgattacctcgtctcatctgatgtggagcatcgagatgttacggataagcaacgaggggtcatatatgctggcaacctttctaggcataaatgttctttcatatatactgaaggatgcgattttactctctttggtgtcaactatgaaaataaagataatcctaaatatcttggaagttttgatgctcaatctccggaaaagattaacctcccaggcatgcaatttggactcatttgggatggagattctgtcgaaacctgtagtggtgcctttggcgactatttaaagtttaataaccctcataagacatctctttatctttcaatggaacttccagtatttatatgggataaagccgcccttgcggatttcattgtagataatagaataggatatgcagtgggatcaatcaaagaaatgcaagagattgttgactccatgacaatagaaacttataagcaaattagtgagaatacaaaaattatttctcagaaaattcgaacaggaagttacttcagggatgttcttgaagaggtgatcgatgatcttaaaactcgctaa

SEQ ID NO: 218 - DNA, 1167 bp, E. Coli
atgatctatcttgtaattagtgtctttctcattacagcatttatctgtttatatcttaagaaggatatattttatccagccgtatgcgttaatatcatcttcgcactggtcttattgggatatgaaataacgtcagatatatatgcttttcagttaaatgacgctacgttgatttttctactttgcaatgttttgacatttaccctgtcatgtttattgacggaaagtgtattagatctaaatatcagaaaagtcaataatgctatttatagcataccatcgaagaaagtgcataatgtaggcttgttagttatttctttttcgatgatatatatatgcatgaggttaagtaactaccagttcgggactagcttacttagctatatgaatttgataagagatgctgatgttgaagacacatcaagaaatttctcagcatacatgcagccaatcattctaactacttttgctttatttatttggtctaaaaaatttactaatacaaaggtaagtaaaacatttactttacttgtttttattgtattcatctttgcaattatactgaatactggtaagcaaattgtctttatggttatcatctcttatgcattcatcgtaggtgttaatagagtaaaacattatgtttatcttattacagctgtaggtgttctattctccttgtatatgctctttttacgtggactgcctggggggatggcatattatctatccatgtatttggtcagccctataatcgcgtttcaggagttttattttcagcaagtatctaactctgccagttctcatgtcttttggttttttgaaaggctgatggggctattaacaggtggagtctctatgtcgttgcataaagaatttgtgtgggtgggtttgccaacaaatgtttatactgctttttcggattatgtttatatttccgcggagctaagctatttgatgatggttattcatggctgtatttcaggtgttttatggagattgtctcgaaattacatatctgtgaaaatattttattcatattttatttataccttttctttcattttttatcatgaaagcttcatgactaatattagcagttggatacaaataactctttgtatcatagtattctctcaatttcttaaggcccagaaaataaagtga

SEQ ID NO: 219 - DNA, 1104 bp, E. Coli
atgtacgattatatcattgttggttctggtttgtttggtgccgtttgtgcgaatgagttaaaaaagctaaacaaaaaagttttagtgattgagaaaagaaatcatatcggtggaaatgcgtacacagaggactgtgagggtatccagattcataaatatggtgcacatatttttcataccaatgataaatatatatgggattacgttaatgatttagtagaatttaatcgttttactaattctccactggcgatttataaagacaaattattcaaccttccttttaatatgaatactttccaccaaatgtggggagttaaagatcctcaagaagctcaaaatatcattaatgctcagaaaaaaaagtatggtgacaaggtacctgaaaatttggaggagcaggcgatttcattagttggggaggacttataccaagcattgataaagggttatacggagaagcagtggggaagaagtgcaaaagaattgcctgcatttattattaagcgaatcccagtgagatttacgtttgataacaattatttttccgatcgctatcaaggtattccggtgggaggctacactaagcttattgaaaaaatgcttgaaggtgtggacgtaaaattaggcattgattttttgaaagacaaagattctctagcgagtaaagcccatagaatcatctacactggacccattgatcagtacttcgactataggtttggagcgttagaatatcgctctttaaaatttgagacggaacgccatgaatttccaaacttccaagggaatgcagtaataaatttcactgatgctaatgtaccatataccagaataattgagcataaacattttgactatgttgagacaaagcatacggttgttacaaaagaatatccattagagtggaaagttggcgacgaaccctactatccagttaatgataataaaaacatggagctttttaagaaatatagagagttagctagcagagaagacaaggttatatttggcgggcgtttggccgagtataaatattatgatatgcatcaagtgatatctgccgctctttatcaagtgaaaaatataatgagtacggattaa

SEQ ID NO: 220 - DNA, 1116 bp, E. Coli
atgttcccaaaaataatgaatgatgaaaactttttcaaaaaagcggcggcgcacggggaggaacctcctttaactcctcaaaacgaacatcagcggtccgggctgcgcttcgcccgtcgcgtcagactaccccgtgcggttggcctggctggcatgttcttaccgattgcttcaacgctggtttcacacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgccttgtcaccctcgagctgacgggcattaccgtgtcgttcaatagtgcgccgctggaatggtggctctcccttcccattattgtcatttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcatgaagggctaaatacattacgtttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctga

SEQ ID NO: 221 - DNA, 1404 bp, E. Coli
ttggatgtgaacgttgatcagttcgatactgaagctttccgtactgacaaactggaactgaccagcggcaacatcgctgaccataacggtaacgtagtatctggtgtgttcgatatccatagcagcgattacgttctgaacgctgatctggtgaacgaccgtacctgggatacttccaagtctaactacggttacggtattgttgctatgaactctgatggtcacctgactatcaacggtaacggcgacgtagacaacggtactgaactggataacagctctgtagacaatgttgttgctgcaaccggtaactacaaagttcgtatcgacaacgcaactggcgctggcgctatcgctgattacaaagataaagaaattatctacgtaaacgacgtcaacagcaacgcgaccttctctgctgctaacaaagctgacctgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggcgattccatcgataacggtactgaagggtctgcggtacgtgttggtctgggtactcagtttagcttcaccaagaacttcagcgcctataccgatgctaactacctcggtggtggtgacgtagatcaagactggtccgcgaacgtgggtgttaaatatacctggtaa

SEQ ID NO: 222 - DNA, 669 bp, E. Coli
atgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggagttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaa

SEQ ID NO: 223 - DNA, 255 bp, E. Coli
atgaccgataaaatccgtactctgcaaggtcgcgttgttagcgacaaaatggagaaatccattgttgttgctatcgaacgttttgtgaaacacccgatctacggtaaattcatcaagcgtacgaccaaactgcacgtacatgacgagaacaacgaatgcggtatcggtgacgtggttgaaatccgcgaatgccgtccgctgtccaagactaaatcctggacgctggttcgcgttgtagagaaagcggttctgtaa

SEQ ID NO: 224 - DNA, 192 bp, E. Coli
atgaaagcaaaagagctgcgtgagaagagcgttgaagagctgaacaccgagctgctgaacctgctgcgtgagcagttcaacctgcgtatgcaggctgcaagtggccagctgcaacagtctcacctgttgaagcaagtgcgtcgcgatgtcgcacgcgttaagactttactgaacgagaaggcgggtgcgtaa

SEQ ID NO: 225 - DNA, 411 bp, E. Coli
atgttacaaccaaagcgtacaaaattccgtaaaatgcacaaaggccgtaaccgcggtctggcgcagggtacggatgttagcttcggcagcttcggtctgaaagctgttggccgtggtcgtctgactgcccgtcagatcgaagcagcacgtcgtgctatgacccgtgcagttaagcgtcaaggtaagatctggatccgtgtgttcccggacaaaccgatcactgaaaagccgctggcagtgcgtatgggtaaaggtaaaggtaacgtggagtattgggttgccttgattcagccgggtaaagtcctgtatgaaatggacggtgttccggaagagctggcccgtgaagcattcaagctggcagcagcgaaactgccgattaaaaccacctttgtaactaagacggtgatgtaa

SEQ ID NO: 226 - DNA, 702 bp, E. Coli
atgggtcagaaagtacatcctaatggtattcgcctgggtattgtaaaaccatggaactctacctggtttgcgaacaccaaagaattcgctgacaacctggacagcgattttaaagtacgtcagtacctgactaaggaactggctaaagcgtccgtatctcgtatcgttatcgagcgtccggctaagagcatccgtgtaaccattcacactgctcgcccgggtatcgttatcggtaaaaaaggtgaagacgtagaaaaactgcgtaaggtcgtagcggacatcgctggcgttcctgcacagatcaacatcgccgaagttcgtaagcctgaactggacgcaaaactggttgctgacagcatcacttctcagctggaacgtcgcgttatgttccgtcgtgctatgaagcgtgctgtacagaacgcaatgcgtctgggcgctaaaggtattaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttacggtgtaatcggcgttaaagtgtggatcttcaaaggcgagatcctgggtggtatggctgctgttgaacaaccggaaaaaccggctgctcagcctaaaaagcagcagcgtaaaggccgtaaataa

SEQ ID NO: 227 - DNA, 333 bp, E. Coli
atggaaactatcgctaaacatcgccatgctcgttcttctgctcagaaggttcgccttgttgctgacctgattcgcggtaagaaagtgtcgcaggctctggatattttgacctacaccaacaagaaagcggctgtactggtcaagaaagttctggaatctgccattgctaacgctgaacacaacgatggcgctgacattgacgatctgaaagttacgaaaattttcgtagacgaaggcccgagcatgaagcgcattatgccgcgtgcaaaaggtcgtgcagatcgcatcctgaagcgcaccagccacatcactgtggttgtgtccgatcgctga

SEQ ID NO: 228 - DNA, 279 bp, E. Coli
atgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccggtatttgtaaccgacgaaatggttggtcacaaactgggtgaattcgcaccgactcgtacttatcgcggccacgctgctgataaaaaagcgaagaagaaataa

SEQ ID NO: 229 - DNA, 822 bp, E. Coli
atggcagttgttaaatgtaaaccgacatctccgggtcgtcgccacgtagttaaagtggttaaccctgagctgcacaagggcaaaccttttgctccgttgctggaaaaaaacagcaaatccggtggtcgtaacaacaatggccgtatcaccactcgtcatatcggtggtggccacaagcaggcttaccgtattgttgacttcaaacgcaacaaagacggtatcccggcagttgttgaacgtcttgagtacgatccgaaccgttccgcgaacatcgcgctggttctgtacaaagacggtgaacgccgttacatcctggcccctaaaggcctgaaagctggcgaccagattcagtctggcgttgatgctgcaatcaaaccaggtaacaccctgccgatgcgcaacatcccggttggttctactgttcataacgtagaaatgaaaccaggtaaaggcggtcagctggcacgttccgctggtacttacgttcagatcgttgctcgtgatggtgcttatgtcaccctgcgtctgcgttctggtgaaatgcgtaaagtagaagcagactgccgtgcaactctgggcgaagttggcaatgctgagcatatgctgcgcgttctgggtaaagcaggtgctgcacgctggcgtggtgttcgtccgaccgttcgcggtaccgcgatgaacccggtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataa

SEQ ID NO: 230 - DNA, 303 bp, E. Coli
atgattcgtgaagaacgtctgctgaaggtgctgcgtgcaccgcacgtttctgaaaaagcgtctactgcgatggaaaaatccaacaccatcgtactcaaagttgctaaagacgcgaccaaagcagaaatcaaagctgctgtgcagaaactgtttgaagtcgaagtcgaagtcgttaacaccctggtagttaaagggaaagttaaacgtcacggacagcgtatcggtcgtcgtagcgactggaaaaaagcttacgtcaccctgaaagaaggccagaatctggacttcgttggcggcgctgagtaa

SEQ ID NO: 231 - DNA, 630 bp, E. Coli
atgattggtttagtcggtaaaaaagtgggtatgacccgtatcttcacagaagacggcgtttctatcccagtaaccgtaatcgaagttgaagcaaaccgcgttactcaggttaaagacctggctaacgatggctaccgtgctattcaggtgaccaccggtgctaaaaaagctaaccgtgtgaccaagcctgaagctggccacttcgctaaagctggcgtagaagctggccgtggtctgtgggaattccgcctggctgaaggcgaagagttcactgtaggtcagagcattagcgttgaactgtttgctgacgttaaaaaagttgacgtaactggcacctctaaaggtaaaggtttcgcaggtaccgttaagcgctggaacttccgtacccaggacgctactcacggtaactccttgtctcaccgcgttccgggttctatcggtcagaaccagactccgggcaaagtgttcaaaggcaagaaaatggcaggtcagatgggtaacgaacgtgtaaccgttcagagccttgacgtagtacgcgttgacgctgagcgcaacctgctgctggttaaaggtgctgtcccgggtgcaaccggtagcgacctgatcgttaaaccagctgtgaaggcgtaa

SEQ ID NO: 232 - DNA, 606 bp, E. Coli
atggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttccggtaaaaaaccgtggcgccagaaaggcaccggccgtgcgcgttctggttctatcaagagcccgatctggcgttctggtggcgtgacctttgctgctcgtccgcaggaccacagtcaaaaagttaacaagaagatgtaccgcggcgcgctgaaaagcatcctgtccgaactggtacgtcaggatcgtctgatcgttgtcgagaagttctctgtagaagcgccgaaaactaagctgctggcacagaaactgaaagacatggctctggaagatgtgctgatcatcaccggtgagctggacgaaaacctgttcctggctgcgcgcaacctgcacaaggttgacgtacgcgatgcaactggtatcgacccggttagcctgatcgccttcgacaaagtcgtaatgactgctgatgctgttaagcaagttgaggagatgctggcatga

SEQ ID NO: 233 - DNA, 312 bp, E. Coli
atgcagaaccaaagaatccgtatccgcctgaaagcgtttgatcatcgtctgatcgatcaagcaaccgcggaaatcgtcgagactgccaagcgcactggtgcgcaggtccgtggtccgatcccgctgccgacacgcaaagagcgcttcactgttctgatctccccgcacgtcaacaaagacgcgcgcgatcagtacgaaatccgtactcacttgcgtctggttgacatcgttgagccaaccgagaaaaccgttgatgctctgatgcgtctggatctggctgccggtgtagacgtgcagatcagcctgggttaa

SEQ ID NO: 234 - DNA, 357 bp, E. Coli
atggctcgcgtaaaacgtggtgttattgcacgtgcacgtcacaagaaaattttgaaacaagctaaaggctactacggtgcgcgttctcgcgtataccgcgttgccttccaggctgttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaatggcctgaaaaaagcctctgttgaaatcgaccgtaagatcctggctgatatcgcagtattcgacaaagtagcgttcaccgctctggttgaaaaagcgaaagcagctctggcataa

SEQ ID NO: 235 - DNA, 198 bp, E. Coli
atgccaaaaattaagaccgtacgcggtgctgctaagcgcttcaaaaaaaccggtaaaggtggttttaagcacaagcacgctaacctgcgtcacattctgaccaaaaaagcgaccaaacgtaaacgtcacctgcgtccgaaagccatggtttccaaaggcgatctgggcctggtaatcgcgtgcctgccgtacgcataa

SEQ ID NO: 236 - DNA, 543 bp, E. Coli
attaaaggcggaaaacgagttcaaacggcgcgccctaaccgtatcaatggcgaaattcgcgcccaggaagttcgcttaacaggtctggaaggcgagcagcttggtattgtgagtctgagagaagctctggagaaagcagaagaagccggagtagacttagtcgagatcagccctaacgccgagccgccggtttgtcgtataatggattacggcaaattcctctatgaaaagagcaagtcttctaaggaacagaagaaaaagcaaaaagttatccaggttaaggaaattaaattccgtcctggtacagatgaaggcgactatcaggtaaaactccgcagcctgattcgctttctcgaagagggtgataaagccaaaatcacgctgcgtttccgcggtcgtgagatggcgcaccagcaaatcggtatggaagtgcttaatcgcgtgaaagacgatttgcaagaactggcagtggtcgaatccttcccaacgaagatcgaaggccgccagatgatcatggtgctcgctcctaagaagaaacagtaa

SEQ ID NO: 237 - DNA, 1929 bp, E. Coli
atgcctgttataactcttcctgatggcagccaacgccattacgatcacgctgtaagccccatggatgttgcgctggacattggtccaggtctggcgaaagcctgtatcgcagggcgcgttaatggcgaactggttgatgcttgcgatctgattgaaaacgacgcacaactgtcgatcattaccgccaaagacgaagaaggtctggagatcattcgtcactcctgtgcgcacctgttagggcacgcgattaaacaactttggccgcataccaaaatggcaatcggcccggttattgacaacggtttttattacgacgttgatcttgaccgcacgttaacccaggaagatgtcgaagcactcgagaagcggatgcatgagcttgctgagaaaaactacgacgtcattaagaagaaagtcagctggcacgaagcgcgtgaaactttcgccaaccgtggggagagctacaaagtctccattcttgacgaaaacatcgcccatgatgacaagccaggtctgtacttccatgaagaatatgtcgatatgtgccgcggtccgcacgtaccgaacatgcgtttctgccatcatttcaaactaatgaaaacggcaggggcttactggcgtggcgacagcaacaacaaaatgttgcaacgtatttacggtacggcgtgggcagacaaaaaagcacttaacgcttacctgcagcgcctggaagaagccgcgaaacgcgaccaccgtaaaatcggtaaacagctcgacctgtaccatatgcaggaagaagcgccgggtatggtattctggcacaacgacggctggaccatcttccgtgaactggaagtgtttgttcgttctaaactgaaagagtaccagtatcaggaagttaaaggtccgttcatgatggaccgtgtcctgtgggaaaaaaccggtcactgggacaactacaaagatgcaatgttcaccacatcttctgagaaccgtgaatactgcattaagccgatgaactgcccgggtcacgtacaaattttcaaccaggggctgaagtcttatcgcgatctgccgctgcgtatggccgagtttggtagctgccaccgtaacgagccgtcaggttcgctgcatggcctgatgcgcgtgcgtggatttacccaggatgacgcgcatatcttctgtactgaagaacaaattcgcgatgaagttaacggatgtatccgtttagtctatgatatgtacagcacttttggcttcgagaagatcgtcgtcaaactctccactcgtcctgaaaaacgtattggcagcgacgaaatgtgggatcgtgctgaggcggacctggcggttgcgctggaagaaaacaacatcccgtttgaatatcaactgggtgaaggcgctttctacggtccgaaaattgaatttaccctgtatgactgcctcgatcgtgcatggcagtgcggtacagtacagctggacttctctttgccgtctcgtctgagcgcttcttatgtaggcgaagacaatgaacgtaaagtaccggtaatgattcaccgcgcaattctggggtcgatggaacgtttcatcggtatcctgaccgaagagttcgctggtttcttcccgacctggcttgcgccggttcaggttgttatcatgaatattaccgattcacagtctgaatacgttaacgaattgacgcaaaaactatcaaatgcgggcattcgtgttaaagcagacttgagaaatgagaagattggctttaaaatccgcgagcacactttgcgtcgcgtcccatatatgctggtctgtggtgataaagaggtggaatcaggcaaagttgccgttcgcacccgccgtggtaaagacctgggaagcatggacgtaaatgaagtgatcgagaagctgcaacaagagattcgcagccgcagtcttaaacaattggaggaataa

SEQ ID NO: 238 - DNA, 1353 bp, E. Coli
atgactaaacactatgattacatcgccatcggcggcggcagcggcggtatcgcctccatcaaccgcgcggctatgtacggccagaaatgtgcgctgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgaaaacgtgctcggtaaaaataacgttgatgtaatcaaaggctttgcccgcttcgttgatgccaaaacgctggaggtaaacggcgaaaccatcacggccgatcatattctgatcgccacaggcggtcgtccgagccacccggatattccgggcgtggaatacggtattgattctgatggcttcttcgcccttcctgctttgccagagcgcgtggcggttgttggcgcgggttacatcgccgttgagctggcgggcgtgattaacggcctcggcgcgaaaacgcatctgtttgtgcgtaaacatgcgccgctgcgcagcttcgacccgatgatttccgaaacgctggtcgaagtgatgaacgccgaaggcccgcagctgcacaccaacgccatcccgaaagcggtagtgaaaaataccgatggtagcctgacgctggagctggaagatggtcgcagtgaaacggtggattgcctgatttgggcgattggtcgcgagcctgccaatgacaacatcaacctggaagccgctggcgttaaaactaacgaaaaaggctatatcgtcgtcgataaatatcaaaacaccaatattgaaggtatttacgcggtgggcgataacacgggtgcagtggagctgacaccggtggcagttgcagcgggtcgccgtctctctgaacgcctgtttaataacaagccggatgagcatctggattacagcaacattccgaccgtggtcttcagccatccgccgattggtactgttggtttaacggaaccgcaggcgcgcgagcagtatggcgacgatcaggtgaaagtgtataaatcctctttcaccgcgatgtataccgccgtcaccactcaccgccagccgtgccgcatgaagctggtgtgcgttggatcggaagagaagattgtcggtattcacggcattggctttggtatggacgaaatgttgcagggcttcgcggtggcgctgaagatgggggcaaccaaaaaagacttcgacaataccgtcgccattcacccaacggcggcagaagagttcgtgacaatgcgttaa

SEQ ID NO: 239 - DNA, 2904 bp, E. Coli
aaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccatccgcgagggacctcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacc

SEQ ID NO: 240 - DNA, 120 bp, E. Coli
atgcctggcagttccctactctcgcatggggagaccccacactaccatcggcgctacggcgtttcacttctgagttcggcatggggtcaggtgggaccaccgcgctacggccgccaggca

SEQ ID NO: 241 - DNA, 76 bp, E. Coli
gtccccttcgtctagaggcccaggacaccgccctttcacggcggtaacaggggttcgaatcccctaggggacgcca

SEQ ID NO: 242 - DNA, 1549 bp, E. Coli; identical to SEQ ID NO: 89

SEQ ID NO: 243 - protein, 221 aa, E. Coli
MNVFSQTQRYKALFWLSLFHLLVITSSNYLVQLPVSILGFHTTWGAFSFPFIFLATDLTVRIFGAPLARRIIFAVMIPALLISYVISSLFYMGSWQGFGALAHFNLFVARIATASFMAYALGQILDVHVFNRLRQSRRWWLAPTASTLFGNVSDTLAFFFIAFWRSPDAFMAEHWMEIALVDYCFKVLISIVFFLPMYGVLLNMLLKRLADKSEINALQAS

SEQ ID NO: 244 - protein, 203 aa, E. Coli
MIRWMNEPLWPFIERKKSMRNLVKYVGIGLLVMGLAACDDKDTNATAQGSVAESNATGNPVNLLDGKLSFSLPADMTDQSGKLGTQANNMHVWSDATGQKAVIVIMGDDPKEDLAVLAKRLEDQQRSRDPQLQVVTNKAIELKGHKMQQLDSIISAKGQTAYSSVILGNVGNQLLTMQITLPADDQQKAQTTAENIINTLVIQ

SEQ ID NO: 245 - protein, 324 aa, E. Coli
MANMFALILVIATLVTGILWCVDKFFFAPKRRERQAAAQAAAGDSLDKATLKKVAPKPGWLETGASVFPVLAIVLIVRSFIYEPFQIPSGSMMPTLLIGDFILVEKFAYGIKDPIYQKTLIETGHPKRGDIVVFKYPEDPKLDYIKRAVGLPGDKVTYDPVSKELTIQPGCSSGQACENALPVTYSNVEPSDFVQTFSRRNGGEATSGFFEVPKNETKENGIRLSERKETLGDVTHRILTVPIAQDQVGMYYQQPGQQLATWIVPPGQYFMMGDNRDNSADSRYWGFVPEANLVGRATAIWMSFDKQEGEWPTGLRLSRIGGIH

SEQ ID NO: 246 - protein, 586 aa, E. Coli
MTITKLAWRDLVPDTDSYQEIFAQPHLIDENDPLFSDTQPRLQFALEQLLHTRASSSFMLAKAPEESEYLNLIANAARTLQSDAGQLVGGHYEVSGHSIRLRHAVSADDNFATLTQVVAADWVEAEQLFGCLRQFNGDITLQPGLVHQANGGILIISLRTLLAQPLLWMRLKNIVNRERFDWVAFDESRPLPVSVPSMPLKLKVILVGERESLADFQEMEPELSEQAIYSEFEDTLQIVDAESVTQWCRWVTFTARHNHLPAPGADAWPILIREAARYTGEQETLPLSPQWILRQCKEVASLCDGDTFSGEQLNLMLQQREWREGFLAERMQDEILQEQILIETEGERIGQINALSVIEFPGHPRAFGEPSRISCVVHIGDGEFTDIERKAELGGNIHAKGMMIMQAFLMSELQLEQQIPFSASLTFEQSYSEVDGDSASMAELCALISALADVPVNQSIAITGSVDQFGRAQPVGGLNEKIEGFFAICQQRELTGKQGVIIPTANVRHLSLHSELVKAVEEGKFTIWAVDDVTDALPLLLNLVWDGEGQTTLMQTIQERIAQASQQEGRHRFPWPLRWLNWFIPN

SEQ ID NO: 247 - protein, 394 aa, E. Coli [sequence omitted]

SEQ ID NO: 248 - protein, 704 aa, E. Coli
MARTTPIARYRNIGISAHIDAGKTTTTERILFYTGVNHKIGEVHDGAATMDWMEQEQERGITITSAATTAFWSGMAKQYEPHRINIIDTPGHVDFTIEVERSMRVLDGAVMVYCAVGGVQPQSETVWRQANKYKVPRIAFVNKMDRMGANFLKVVNQIKTRLGANPVPLQLAIGAEEHFTGVVDLVKMKAINWNDADQGVTFEYEDIPADMVELANEWHQNLIESAAEASEELMEKYLGGEELTEAEIKGALRQRVLNNEIILVTCGSAFKNKGVQAMLDAVIDYLPSPVDVPAINGILDDGKDTPAERHASDDEPFSALAFKIATDPFVGNLTFFRVYSGVVNSGDTVLNSVKAARERFGRIVQMHANKREEIKEVRAGDIAAAIGLKDVTTGDTLCDPDAPIILERMEFPEPVISIAVEPKTKADQEKMGLALGRLAKEDPSFRVWTDEESNQTIIAGMGELHLDIIVDRMKREFNVEANVGKPQVAYRETIRQKVTDVEGKHAKQSGGRGQYGHVVIDMYPLEPGSNPKGYEFINDIKGGVIPGEYIPAVDKGIQEQLKAGPLAGYPVVDMGIRLHFGSYHDVDSSELAFKLAASIAFKEGFKKAKPVLLEPIMKVEVETPEENTGDVIGDLSRRRGMLKGQESEVTGVKIHAEVPLSEMFGYATQLRSLTKGRASYTMEFLKYDEAPSNVAQAVIEARGK

SEQ ID NO: 249 - protein, 179 aa, E. Coli
MPRRRVIGQRKILPDPKFGSELLAKFVNILMVDGKKSTAESIVYSALETLAQRSGKSELEAFEVALENVRPTVEVKSRRVGGSTYQVPVEVRPVRRNALAMRWIVEAARKRGDKSMALRLANELSDAAENKGTAVKKREDVHRMAEANKAFAHYRWLSLRSFSHQAGASSKQPALGYLN

SEQ ID NO: 250 - protein, 124 aa, E. Coli
MATVNQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 251 - protein, 165 aa, E. Coli
MALNLQDKQAIVAEVSEVAKGALSAVVADSRGVTVDKMTELRKAGREAGVYMRVVRNTLLRRAVEGTPFECLKDAFVGPTLIAYSMEHPGAAARLFKEFAKANAKFEVKAAAFEGELIPASQIDRLATLPTYEEAIARLMATMKEASAGKLVRTLAAVRDAKEAA

SEQ ID NO: 252 - protein, 121 aa, E. Coli
MSITKDQIIEAVAAMSVMDVVELISAMEEKFGVSAAAAVAVAAGPVEAAEEKTEFDVILKAAGANKVAVIKAVRGATGLGLKEAKDLVESAPAALKEGVSKDDAEALKKALEEAGAEVEVK

SEQ ID NO: 253 - protein, 714 aa, E. Coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 254 - protein, 588 aa, E. Coli
MNNSINHKFHHISRAEYQELLAVSRGDAVADYIIDNVSILDLINGGEISGPIVIKGRYIAGVGAEYTDAPALQRIDARGATAVPGFIDAHLHIESSMMTPVTFETATLPRGLTTVICDPHEIVNVMGEAGFAWFARCAEQARQNQYLQVSSCVPALEGCDVNGASFTLEQMLAWRDHPQVTGLAEMMDYPGVISGQNALLDKLDAFRHLTLDGHCPGLGGKELNAYITAGIENCHESYQLEEGRRKLQLGMSLMIREGSAARNLNALAPLINEFNSPQCMLCTDDRNPWEIAHEGHIDALIRRLIEQHNVPLHVAYRVASWSTARHFGLNHLGLLAPGKQADIVLLSDARKVTVQQVLVKGEPIDAQTLQAEESARLAQSAPPYGNTIARQPVSASDFALQFTPGKRYRVIDVIHNELITHSHSSVYSENGFDRDDVSFIAVLERYGQRLAPACGLLGGFGLNEGALAATVSHDSHNIVVIGRSAEEMALAVNQVIQDGGGLCVVRNGQVQSHLPLPIAGLMSTDTAQSLAEQIDALKAAARECGPLPDEPFIQMAFLSLPVIPALKLTSQGLFDGEKFAFTTLEVTE

SEQ ID NO: 255 - protein, 408 aa, E. Coli
MAYCNPGLESRPNKRNALRRHVVTGIGMKIVIAPDSYKESLSASEVAQAIEKGFREIFPDAQYVSVPVADGGEGTVEAMIAATQGAERHAWVTGPLGEKVNASWGISGDGKTAFIEMAAASGLELVPAEKRDPLVTTSRGTGELILQALESGATNIIIGIGGSATNDGGAGMVQALGAKLCDANGNEIGFGGGSLNTLNDIDISGLDPRLKDCVIRVACDVTNPLVGDNGASRIFGPQKGASEAMIVELDNNLSHYAEVIKKALHVDVKDVPGAGAAGGMGAALMAFLGAELKSGIEIVTTALNLEEHIHDCTLVITGEGRIDSQSIHGKVPIGVANVAKKYHKPVIGIAGSLTDDVGVVHQHGIDAVFSVLTSIGTLDEAFRGAYDNICRASRNIAATLAIGMRNAG

SEQ ID NO: 256 - protein, 299 aa, E. Coli
MIDMTMKVGFIGLGIMGKPMSKNLLKAGYSLVVADRNPEAIADVIAAGAETASTAKAIAEQCDVIITMLPNSPHVKEVALGENGIIEGAKPGTVLIDMSSIAPLASREISEALKAKGIDMLDAPVSGGEPKAIDGTLSVMVGGDKAIFDKYYDLMKAMAGSVVHTGEIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGTADHSALACYYEKLAKVEVTR

SEQ ID NO: 257 - protein, 256 aa, E. Coli [sequence omitted]

SEQ ID NO: 258 - protein, 444 aa, E. Coli
MILDTVDEKKKGVHTRYLILLIIFIVTAVNYADRATLSIAGTEVAKELQLSAVSMGYIFSAFGWAYLLMQIPGGWLLDKFGSKKVYTYSLFFWSLFTFLQGFVDMFPLAWAGISMFFMRFMLGFSEAPSFPANARIVAAWFPTKERGTASAIFNSAQYFSLALFSPLLGWLTFAWGWEHVFTVMGVIGFVLTALWIKLIHNPTDHPRMSAEELKFISENGAVVDMDHKKPGSAAASGPKLHYIKQLLSNRMMLGVFFGQYFINTITWFFLTWFPIYLVQEKGMSILKVGLVASIPALCGFAGGVLGGVFSDYLIKRGLSLTLARKLPIVLGMLLASTIILCNYTNNTTLVVMLMALAFFGKGFGALGWPVISDTAPKEIVGLCGGVFNVFGNVASIVTPLVIGYLVSELHSFNAALVFVGCSALMAMVCYLFVVGDIKRMELQK

SEQ ID NO: 259 - protein, 511 aa, E. Coli
MQTSDTRALPLLCARSVYKQYSGVNVLKGIDFTLHQGEVHALLGGNGAGKSTLMKIIAGITPADSGTLEIEGNNYVRLTPVHAHQLGIYLVPQEPLLFPSLSIKENILFGLAKKQLSMQKMKNLLAALGCQFDLHSLAGSLDVADRQMVEILRGLMRDSRILILDEPTASLTPAETERLFSRLQELLATGVGIVFISHKLPEIRQIADRISVMRDGTIALSGKTSELSTDDIIQAITPAVREKSLSASQKLWLELPGNRPQHAAGTPVLTLENLTGEGFRNVSLTLNAGEILGLAGLVGAGRTELAETLYGLRTLRGGRIMLNGKEINKLSTGERLLRGLVYLPEDRQSSGLNLDASLAWNVCALTHNLRGFWAKTAKDNATLERYRRALNIKFNQPEQAARTLSGGNQQKILIAKCLEASPQVLIVDEPTRGVDVSARNDIYQLLRSIAAQNVAVLLISSDLEEIELMADRVYVMHQGEITHSALTERDINVETIMRVAFGDSQRQEASC

SEQ ID NO: 260 - protein, 342 aa, E. Coli
MLKFIQNNREITALLAVVLLFVLPGFLDRQYLSVQTLTMVYSSAQILILLAMGATLVMLTRNIDVSVGSITGMCAVLLGMLLNAGYSLPVACVATLLLGLLAGFFNGVLVAWLKIPAIVATLGTLGLYRGIMLLWTGGKWIEGLPAELKQLSAPLLLGVSAIGWLTIILVAFMAWLLAKTAFGRSFYATGDNLQGARQLGVRTEAIRIVAFSLNGCMAALAGIVFASQIGFIPNQTGTGLEMKAIAACVLGGISLLGGSGAIIGAVLGAWFLTQIDSVLVLLRIPAWWNDFIAGLVLLAVLVFDGRLRCALERNLRRQKYARFMTPPPSVKPASSGKKREAA

SEQ ID NO: 261 - protein, 330 aa, E. Coli
MRIRYGWELALAALLVIEIVAFGAINPRMLDLNMLLFSTSDFICIGIVALPLTMVIVSGGIDISFGSTIGLCAIALGVLFQSGVPMPLAILLTLLLGALCGLINAGLIIYTKVNPLVITLGTLYLFAGSALLLSGMAGATGYEGIGGFPMAFTDFANLDVLGLPVPLIIFLICLLVFWLWLHKTHAGRNVFLIGQSPRVALYSAIPVNRTLCALYAMTGLASAVAAVLLVSYFGSARSDLGASFLMPAITAVVLGGANIYGGSGSIIGTAIAVLLVGYLQQGLQMAGVPNQVSSALSGALLIVVVVGRSVSLHRQQIKEWLARRANNPLP

SEQ ID NO: 262 - protein, 340 aa, E. Coli
MTLHRFKKIALLSALGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIKGVGQVEVSPNSVQGYDYEADGNGIVLLPERVIFNKENIGKYDF

SEQ ID NO: 263 - protein, 291 aa, E. Coli
MADLDDIKDGKDFRTDQPQKNIPFTLKGCGALDWGMQSRLSRIFNPKTGKTVMLAFDHGYFQGPTTGLERIDINIAPLFEHADVLMCTRGILRSVVPPATNRPVVLRASGANSILAELSNEAVALSMDDAVRLNSCAVAAQVYIGSEYEHQSIKNIIQLVDAGMKVGMPTMAVTGVGKDMVRDQRYFSLATRIAAEMGAQIIKTYYVEKGFERIVAGCPVPIVIAGGKKLPEREALEMCWQAIDQGASGVDMGRNIFQSDHPVAMMKAVQAVVHHNETADRAYELYLSEKQ

SEQ ID NO: 264 - protein, 96 aa, E. Coli
MHVTLVEINVHEDKVDEFIEVFRQNHLGSVQEEGNLRFDVLQDPEVNSRFYIYEAYKDEDAVAFHKTTPHYKTCVAKLESLMTGPRKKRLFNGLMP

SEQ ID NO: 265 - protein, 383 aa, E. Coli
MFEPMELTNDAVIKVIGVGGGGGNAVEHMVRERIEGVEFFAVNTDAQALRKTAVGQTIQIGSGITKGLGAGANPEVGRNAADEDRDALRAALEGADMVFIAAGMGGGTGTGAAPVVAEVAKDLGILTVAVVTKPFNFEGKKRMAFAEQGITELSKHVDSLITIPNDKLLKVLGRGISLLDAFGAANDVLKGAVQGIAELITRPGLMNVDFADVRTVMSEMGYAMMGSGVASGEDRAEEAAEMAISSPLLEDIDLSGARGVLVNITAGFDLRLDEFETVGNTIRAFASDNATVVIGTSLDPDMNDELRVTVVATGIGMDKRPEITLVTNKQVQQPVMDRYQQHGMAPLTQEQKPVAKVVNDNAPQTAKEPDYLDIPAFLRKQAD

SEQ ID NO: 266 - protein, 1014 aa, E. Coli
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQLDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQSEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 267 - protein, 294 aa, E. Coli
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEDHHE

SEQ ID NO: 268 - protein, 217 aa, E. Coli
MSKSKMIVRTKFIDRACHWTVVICFFLVALSGISFFFPTLQWLTQTFGTPQMGRILHPFFGIAIFVALMFMFVRFVHHNIPDKKDIPWLLNIVEVLKGNEHKVADVGKYNAGQKMMFWSIMSMIFVLLVTGVIIWRPYFAQYFPMQVVRYSLLIHAAAGIILIHAILIHMYMAFWVKGSIKGMIEGKVSRRWAKKHHPRWYREIEKAEAKKESEEGI

SEQ ID NO: 269 - protein, 86 aa, E. Coli
MALLITKKCINCDMCEPECPNEAISMGDHIYEINSDKCTECVGHYETPTCQKVCPIPNTIVKDPAHVETEEQLWDKFVLMHHADKI

SEQ ID NO: 270 - protein, 400 aa, E. Coli [sequence omitted]

SEQ ID NO: 271 - protein, 392 aa, E. Coli [sequence omitted]

SEQ ID NO: 272 - protein, 441 aa, E. Coli
MSEISRQEFQRRRQALVEQMQPGSAALIFAAPEVTRSADSEYPYRQNSDFWYFTGFNEPEAVLVLIKSDDTHNHSVLFNRVRDLTAEIWFGRRLGQDAAPEKLGVDRALAFSEINQQLYQLLNGLDVVYHAQGEYAYADVIVNSALEKLRKGSRQNLTAPATMIDWRPVVHEMRLFKSPEEIAVLRRAGEITAMAHTRAMEKCRPGMFEYHLEGEIHHEFNRHGARYPSYNTIVGSGENGCILHYTENECEMRDGDLVLIDAGCEYKGYAGDITRTFPVNGKFTQAQREIYDIVLESLETSLRLYRPGTSILEVTGEVVRIMVSGLVKLGILKGDVDELIAQNAHRPFFMHGLSHWLGLDVHDVGVYGQDRSRILEPGMVLTVEPGLYIAPDAEVPEQYRGIGIRIEDDIVITETGNENLTASVVKKPEEIEALMVAARKQ

SEQ ID NO: 273 - protein, 194 aa, E. Coli
MLMSIQNEMPGYNEMNQYLNQQGTGLTPAEMHGLISGMICGGNDDSSWLPLLHDLTNEGMAFGHELAQALRKMHSATSDALQDDGFLFQLYLPDGDDVSVFDRADALAGWVNHFLLGLGVTQPKLDKVTGETGEAIDDLRNIAQLGYDEDEDQEELEMSLEEIIEYVRVAALLCHDTFTHPQPTAPEVQKPTLH

SEQ ID NO: 274 - protein, 120 aa, E. Coli
MLKLFAKYTSIGVLNTLIHWVVFGVCIYVAHTNQALANFAGFVVAVSFSFFANAKFTFKASTTTMRYMLYVGFMGTLSATVGWAADRCALPPMITLVTFSAISLVCGFVYSKFIVFRDAK

SEQ ID NO: 275 - protein, 306 aa, E. Coli
MKISLVVPVFNEEEAIPIFYKTVREFEELKSYEVEIVFINDGSKDATESIINALAVSDPLVVPLSFTRNFGKEPALFAGLDHATGDAIIPIDVDLQDPIEVIPHLIEKWQAGADMVLAKRSDRSTDGRLKRKTAEWFYKLHNKISNPKIEENVGDFRLMSRDVVENIKLMPERNLFMKGILSWVGGKTDIVEYVRAERIAGDTKFNGWKLWNLALEGITSFSTFPLRIWTYIGLVVASVAFIYGAWMILDTIIFGNAVRGYPSLLVSILFLGGIQMIGIGVLGEYIGRTYIETKKRPKYIIKRVKK

SEQ ID NO: 276 - protein, 443 aa, E. Coli
MNKAIKVSLYISFVLIICALSKNIMMLNTSDFGRAIKPLIEDIPAFTYDLPLLYKLKGHIDSIDSYEYISSYSYILYTYVLFISIFTEYLDARVLSLFLKVIYIYSLYAIFTSYIKTERYVTLFTFFILAFLMCSSSTLSMFASFYQEQIVIIFLPFLVYSLTCKNNKSMLLLFFSLLIISTAKNQFILTPLIVYSYYIFFDRHKLIIKSVICVVCLLASIFAISYSKGVVELNKYHATYFGSYLYMKNNGYKMPSYVDDKCVGLDAWGNKFDISFGATPTEVGTECFESHKDETFSNALFLLVSKPSTIFKLPFDDGVMSQYKENYFHVYKKLHVIYGESNILTTITNIKDNIFKNIRFISLLLFFIASIFIRNNKIKASLFVVSLFGISQFYVSFFGEGYRDLSKHLFGMYFSFDLCLYITVVFLIYKIIQRNQDNSDVKH

SEQ ID NO: 277 - protein, 82 aa, E. Coli
MGILSWIIFGLIAGILAKWIMPGKDGGGFFMTILLGIVGAVVGGWISTLFGFGKVDGFNFGSFVVAVIGAIVVLFIYRKIKS

SEQ ID NO: 278 - protein, 60 aa, E. Coli
MGKATYTVTVTNNSNGVSVDYETETPMTLLVPEVAAEVIKDLVNTVRSYDTENEHDVCGW

SEQ ID NO: 279 - protein, 119 aa, E. Coli
MLQIPQNYIHTRSTPFWNKQTAPAGIFERHLDKGTRPGVYPRLSVMHGAVKYLGYADEHSAEPDQVILIEAGQFAVFPPEKWHNIEAMTDDTYFNIDFFVAPEVLMEGAQQRKVIHNGK

SEQ ID NO: 280 - protein, 246 aa, E. Coli
MKFKVIALAALMGISGMAAQANELPDGPHIVTSGTASVDAVPDIATLAIEVNVAAKDAATAKKQADERVAQYISFLELNQIAKKDISSANLRTQPDYDYQDGKSILKGYRAVRTVEVTLRQLDKLNSLLDGALKAGLNEIRSVSLGVAQPDAYKDKARKAAIDNAIHQAQELANGFHRKLGPVYSVRYHVSNYQPSPMVRMMKADAAPVSAQETYEQAAIQFDDQVDVVFQLEPVDQQPAKTPAAQ

SEQ ID NO: 281 - protein, 464 aa, E. Coli
MLLLDACSQMCPSFRRFQTVFHNSSIFLPYWLATLVSFRETFQEEKLLTMKGSYKSRWVIVIVVVIAAIAAFWFWQGRNDSRSAAPGATKQAQQSPAGGRRGMRSGPLAPVQAATAVEQAVPRYLTGLGTITAANTVTVRSRVDGQLIALHFQEGQQVKAGDLLAEIDPSQFKVALAQAQGQLAKDKATLANARRDLARYQQLAKTNLVSRQELDAQQALVSETEGTIKADEASVASAQLQLDWSRITAPVDGRVGLKQVDVGNQISSGDTTGIVVITQTHPIDLVFTLPESDIATVVQAQKAGKPLVVEAWDRTNSKKLSEGTLLSLDNQIDATTGTIKVKARFNNQDDALFPNQFVNARMLVDTEQNAVVIPTAALQMGNEGHFVWVLNSENKVSKHLVTPGIQDSQKVVIRAGISAGDRVVTDGIDRLTEGAKVEVVEAQSATTPEEKATSREYAKKGARS

SEQ ID NO: 282 - protein, 1040 aa, E. Coli
MQVLPPSSTGGPSRLFIMRPVATTLLMVAILLAGIIGYRALPVSALPEVDYPTIQVVTLYPGASPDVMTSAVTAPLERQFGQMSGLKQMSSQSSGGASVITLQFQLTLPLDVAEQEVQAAINAATNLLPSDLPNPPVYSKVNPADPPIMTLAVTSTAMPMTQVEDMVETRVAQKISQISGVGLVTLSGGQRPAVRVKLNAQAIAALGLTSETVRTAITGANVNSAKGSLDGPSRAVTLSANDQMQSAEEYRQLIIAYQNGAPIRLGDVATVEQGAENSWLGAWANKEQAIVMNVQRQPGANIISTADSIRQMLPQLTESLPKSVKVTVLSDRTTNIRASVDDTQFELMMAIALVVMIIYLFLRNIPATIIPGVAVPLSLIGTFAVMVFLDFSINNLTLMALTIATGFVVDDAIVVIENISRYIEKGEKPLAAALKGAGEIGFTIISLTFSLIAVLIPLLFMGDIVGRLFREFAITLAVAILISAVVSLTLTPMMCARMLSQESLRKQNRFSRASEKMFDRIIAAYGRGLAKVLNHPWLTLSVALSTLLLSVLLWVFIPKGFFPVQDNGIIQGTLQAPQSSSFANMAQRQRQVADVILQDPAVQSLTSFVGVDGTNPSLNSARLQINLKPLDERDDRVQKVIARLQTAVDKVPGVDLFLQPTQDLTIDTQVSRTQYQFTLQATSLDALSTWVPQLMEKLQQLPQLSDVSSDWQDKGLVAYVNVDRDSASRLGISMADVDNALYNAFGQRLISTIYTQANQYRVVLEHNTENTPGLAALDTIRLTSSDGGVVPLSSIAKIEQRFAPLSINHLDQFPVTTISFNVPDNYSLGDAVQAIMDTEKTLNLPVDITTQFQGSTLAFQSALGSTVWLIVAAVVAMYIVLGILYESFIHPITILSTLPTAGVGALLALLIAGSELDVIAIIGIILLIGIVKKNAIMMIDFALAAEREQGMSPREAIYQACLLRFRPILMTTLAALLGALPLMLSTGVGAELRRPLGIGMVGGLIVSQVLTLFTTPVIYLLFDRLALWTKSRFARHEEEA

SEQ ID NO: 283 - protein, 1025 aa, E. Coli
MKFFALFIYRPVATILLSVAITLCGILGFRMLPVAPLPQVDFPVIIVSASLPGASPETMASSVATPLERSLGRIAGVSEMTSSSSLGSTRIILQFDFDRDINGAARDVQAAINAAQSLLPSGMPSRPTYRKANPSDAPIMILTLTSDTYSQGELYDFASTQLAPTISQIDGVGDVDVGGSSLPAVRVGLNPQALFNQGVSLDDVRTAVSNANVRKPQGALEDGTHRWQIQTNDELKTAAEYQPLIIHYNNGGAVRLGDVATVTDSVQDVRNAGMTNAKPAILLMIRKLPEANIIQTVDSIRAKLPELQETIPAAIDLQIAQDRSPTIRASLEEVEQTLIISVALVILVVFLFLRSGRATIIPAVSVPVSLIGTFAAMYLCGFSLNNLSLMALTIATGFVVDDAIVVLENIARHLEAGMKPLQAALQGTREVGFTVLSMSLSLVAVFLPLLLMGGLPGRLLREFAVTLSVAIGISLLVSLTLTPMMCGWMLKASKPREQKRLRGFGRMLVALQQGYGKSLKWVLNHTRLVGVVLLGTIALNIWLYISIPKTFFPEQDTGVLMGGIQADQSISFQAMRGKLQDFMKIIRDDPAVDNVTGFTGGSRVNSGMMFITLKPRDERSETAQQIIDRLRVKLAKEPGANLFLMAVQDIRVGGRQSNASYQYTLLSDDLAALREWEPKIRKKLATLPELADVNSDQQDNGAEMNLVYDRDTMARLGIDVQAANSLLNNAFGQRQISTIYQPMNQYKVVMEVDPRYTQDISALEKMFVINNEGKAIPLSYFAKWQPANAPLSVNHQGLSAASTISFNLPTGKSLSDASAAIDRAMTQLGVPSTVRGSFAGTAQVFQETMNSQVILIIAAIATVYIVLGILYESYVHPLTILSTLPSAGVGALLALELFNAPFSLIALIGIMLLIGIVKKNAIMMVDFALEAQRHGNLTPQEAIFQACLLRFRPIMMTTLAALFGALPLVLSGGDGSELRQPLGITIVGGLVMSQLLTLYTTPVVYLFFDRLRLRFSRKPKQTVTE

SEQ ID NO: 284 - protein, 471 aa, E. Coli
MTDLPDSTRWQLWIVAFGFFMQSLDTTIVNTALPSMAQSLGESPLHMHMVIVSYVLTVAVMLPASGWLADKVGVRNIFFTAIVLFTLGSLFCALSGTLNELLLARALQGVGGAMMVPVGRLTVMKIVPREQYMAAMTFVTLPGQVGPLLGPALGGLLVEYASWHWIFLINIPVGIIGAIATLLLMPNYTMQTRRFDLSGFLLLAVGMAVLTLALDGSKGTGLSPLTIAGLVAVGVVALVLYLLHARNNNRALFSLKLFRTRTFSLGLAGSFAGRIGSGMLPFMTPVFLQIGLGFSPFHAGLMMIPMVLGSMGMKRIVVQVVNRFGYRRVLVATTLGLSLVTLLFMTTALLGWYYVLPFVLFLQGMVNSTRFSSMNTLTLKDLPDNLASSGNSLLSMIMQLSMSIGVTIAGLLLGLFGSQHVSVDSGTTQTVFMYTWLSMALIIALPAFIFARVPNDTHQNVAISRRKRSAQ

SEQ ID NO: 285 - protein, 344 aa, E. Coli
MEIRIMLFILMMMVMPVSYAACYSELSVQHNLVVQGDFALTQTQMATYEHNFNDSSCVSTNTITPMSPSDIIVGLYNDTIKLNLHFEWTNKNNITLSNNQTSFTSGYSVTVTPAASNAKVNVSAGGGGSVMINGVATLSSASSSTRGSAAVQFLLCLLGGKSWDACVNSYRNALAQNAGVYSFNLTLSYNPITTTCKPDDLLITLDSIPVSQLPATGNKATINSKQGDIILRCKNLLGQQNQTSRKMQVYLSSSDLLTNSNTILKGAEDNGVGFILESNGSPVTLLNITNSSKGYTNLKEVAAKSKLTDTTVSIPITASYYVYDTNKVKSGALEATALINVKYD

SEQ ID NO: 286 - protein, 826 aa, E. Coli
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 287 - protein, 239 aa, E. Coli
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 288 - protein, 180 aa, E. Coli
MKRSIIAAAVFSSFFMSAGVFAADVDTGTLTIKGNIAESPCKFEAGGDSVSINMPTVPTSVFEGKAKYSTYDDAVGVTSSMLKISCPKEVAGVKLSLITNDKITGNDKAIASSNDTVGYYLYLGDNSDVLDVSAPFNIESYKTAEGQYAIPFKAKYLKLTDNSVQSGDVLSSLVMRVAQD

SEQ ID NO: 289 - protein, 112 aa, E. Coli
MSSERDLVNFLGDFSMDVAKAVIAGGVATAIGSLASFACVSFGFPVILVGGAILLTGIVCTVVLNEIDAQCHLSEKLKYAIRDGLKRQQELDKWKRENMTPFMYVLNTPPVI

SEQ ID NO: 290 - protein, 193 aa, E. Coli
MTDYLLLFVGTVLVNNFVLVKFLGLCPFMGVSKKLETAMGMGLATTFVMTLASICAWLIDTWILIPLNLIYLRTLAFILVIAVVVQFTEMVVRKTSPVLYRLLGIFLPLITTNCAVLGVALLNINLGHNFLQSALYGFSAAVGFSLVMVLFAAIRERLAVADVPAPFRGNAIALITAGLMSLAFMGFSGLVKL

SEQ ID NO: 291 - protein, 192 aa, E. Coli
MNAIWIAVAAVSLLGLAFGAILGYASRRFAVEDDPVVEKIDEILPQSQCGQCGYPGCRPYAEAISCNGEKINRCAPGGEAVMLKIAELLNVEPQPLDGEAQEITPARMVAVIDENNCIGCTKCIQACPVDAIVGATRAMHTVMSDLCTGCNLCVDPCPTHCISLQPVAETPDSWKWDLNTIPVRIIPVEHHA

SEQ ID NO: 292 - protein, 740 aa, E. Coli
MLKLFSAFRKNKIWDFNGGIHPPEMKTQSNGTPLRQVPLAQRFVIPLKQHIGAEGELCVSVGDKVLRGQPLTRGRGKMLPVHAPTSGTVTAIAPHSTAHPSALAELSVIIDADGEDCWIPRDGWADYRTRSREELIERIHQFGVAGLGGAGFPTGVKLQGGGDKIETLIINAAECEPYITADDRLMQDCAAQVVEGIRILAHILQPREILIGIEDNKPQAISMLRAVLADSNDISLRVIPTKYPSGGAKQLTYILTGKQVPHGGRSSDIGVLMQNVGTAYAVKRAVIDGEPITERVVTLTGEAIARPGNVWARLGTPVRHLLNDAGFCPSADQMVIMGGPLMGFTLPWLDVPVVKITNCLLAPSANELGEPQEEQSCIRCSACADACPADLLPQQLYWFSKGQQHDKATTHNIADCIECGACAWVCPSNIPLVQYFRQEKAEIAAIRQEEKRAAEAKARFEARQARLEREKAARLERHKSAAVQPAAKDKDAIAAALARVKEKQAQATQPIVIKAGERPDNSAIIAAREARKAQARAKQAELQQTNDAATVADPRKTAVEAAIARAKARKLEQQQANAEPEQQVDPRKAAVEAAIARAKARKLEQQQANAEPEEQVDPRKAAVEAAIARAKARKLEQQQANAEPEQQVDPRKAAVEAAIARAKARKREQQPANAEPEEQVDPRKAAVEAAIARAKARKLEQQQANAVPEEQVDPRKAAVAAAIARAQAKKAAQQKVVNED

SEQ ID NO: 293 - protein, 352 aa, E. Coli
MVFRIASSPYTHNQRQTSRIMLLVLLAAVPGIAAQLWFFGWGTLVQILLASVSALLAEALVLKLRKQSVAATLKDNSALLTGLLLAVSIPPLAPWWMVVLGTVFAVIIAKQLYGGLGQNPFNPAMIGYVVLLISFPVQMTSWLPPHEIAVNIPGFIDAIQVIFSGHTASGGDMNTLRLGIDGISQATPLDTFKTSVRAGHSVEQIMQYPIYSGILAGAGWQWVNLAWLAGGVWLLWQKAIRWHIPLSFLVTLALCAMLGWLFSPETLAAPQIHLLSGATMLGAFFILTDPVTASTTNRGRLIFGALAGLLVWLIRSFGGYPDGVAFAVLLANITVPLIDYYTRPRVYGHRKG

SEQ ID NO: 294 - protein, 206 aa, E. Coli
MLKTIRKHGITLALFAAGSTGLTAAINQMTKTTIAEQASLQQKALFDQVLPAERYNNALAQSCYLVTAPELGKGEHRVYIAKQDDKPVAAVLEATAPDGYSGAIQLLVGADFNGTVLGTRVTEHHETPGLGDKIELRLSDWITHFAGKKISGADDAHWAVKKDGGDFDQFTGATITPRAVVNAVKRAGLYAQTLPAQLSQLPACGE

SEQ ID NO: 295 - protein, 231 aa, E. Coli
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFHTDSPFLLAMLPPGAFIGLGLMLAGKYLIDERMKKRRAEAAAERALPNGETGNV

SEQ ID NO: 296 - protein, 211 aa, E. Coli
MNKAKRLEILTRLRENNPHPTTELNFSSPFELLIAVLLSAQATDVSVNKATAKLYPVANTPAAMLELGVEGVKTYIKTIGLYNSKAENIIKTCRILLEQHNGEVPEDRAALEALPGVGRKTANVVLNTAFGWPTIAVDTHIFRVCNRTQFAPGKNVEQVEEKLLKVVPAEFKVDCHHWLILHGRYTCIARKPRCGSCIIEDLCEYKEKVDI

SEQ ID NO: 297 - protein, 167 aa, E. Coli
MKRLHKRFLLATFCALFTATLQAADVTITVNGRVVAKPCTIQTKEANVNLGDLYTRNLQQPGSASGWHNITLSLTDCPVETSAVTAIVTGSTDNTGYYKNEGTAENIQIELRDDQDAALKNGDSKTVIVDEITRNAQFPLKARAITVNGNASQGTIEALINVIYTWQ

SEQ ID NO: 298 - protein, 176 aa, E. Coli
MKYNNIIFLGLCLGLTTYSALSADSVIKISGRVLDYGCTVSSDSLNFTVDLQKNSARQFPTTGSTSPAVPFQITLSECSKGTTGVRVAFNGIEDAENNTLLKLDEGSNTASGLGIEILDANMRPVKLNDLHAGMQWIPLVPEQNNILPYSARLKSTQKSVNPGLVRASATFTLEFQ

SEQ ID NO: 299 - protein, 382 aa, E. Coli [sequence omitted]

SEQ ID NO: 300 - protein, 138 aa, E. Coli
MIAIADILQAGEKLTAVAPFLAGIQNEEQYTQALELVDHLLLNDPENPLLDLVCAKITAWEESAPEFAEFNAMAQAMPGGIAVIRTLMDQYGLTLSDLPEIGSKSMVSRVLSGKRKLTLEHAKKLATRFGISPALFID

SEQ ID NO: 301 - protein, 104 aa, E. Coli
MHLITQKALKDAAEKYPQHKTELVALGNTIAKGYFKKPESLKAVFPSLDNFKYLDKHYVFNVGGNELRVVAMVFFESQKCYIREVMTHKEYDFFTAVHRTKGKK

SEQ ID NO: 302 - protein, 2383 aa, E. Coli
MLSVFTFFRCARKGAFMLARSGKVSMATKKRSGEEINDRQILCGMGIKLRRLTAGICLITQLAFPMAAAAQGVVNAATQQPVPAQIAIANANTVPYTLGALESAQSVAERFGISVAELRKLNQFRTFARSFDNVRQGDELDVPAQVSEKKLTPPPGNSSDNLEQQIASTSQQIGSLLAEDMNSEQAANMARGWASSQASGAMTDWLSRFGTARITLGVDEDFSLKNSQFDFLHPWYETPDNLFFSQHTLHRTDERTQINNGLGWRHFTPTWMSGINFFFDHDLSRYHSRAGIGAEYWRDYLKLSSNGYLRLTNWRSAPELDNDYEARPANGWDVRAESWLPAWPHLGGKLVYEQYYGDEVALFDKDDRQSNPHAITAGLNYTPFPLMTFSAEQRQGKQGENDTRFAVDFTWQPGSAMQKQLDPNEVAARRSLAGSRYDLVDRNNNIVLEYRKKELVRLTLTDPVTGKSGEVKSLVSSLQTKYALKGYNVEATALEAAGGKVVTTGKDILVTLPAYRFTSTPETDNTWPIEVTAEDVKGNLSNREQSMVVVQAPTLSQKDSSVSLSTQTLNADSHSTATLTFIAHDAAGNPVVGLVLSTRHEGVQDITLSDWKDNGDGSYTQILTTGAMSGTLTLMPQLNGVDAAKAPAVVNIISVSSSRTHSSIKIDKDRYLSGNPIEVTVELRDENDKPVKEQKQQLNNAVSIDNVKPGVTTDWKETADGVYKATYTAYTKGSGLTAKLLMQNWNEDLHTAGFIIDANPQSAKIATLSASNNGVLANENAANTVSVNVADEGSNPINDHTVTFAVLSGSATSFNNQNTAKTDVNGLATFDLKSSKQEDNTVEVTLENGVKQTLIVSFVGDSSTAQVDLQKSKNEVVADGNDSVTMTATVRDAKGNLLNDVMVTFNVNSAEAKLSQTEVNSHDGIATATLTSLKNGDYRVTASVSSGSQANQQVNFIGDQSTAALTLSVPSGDITVTNTAPQYMTATLQDKNGNPLKDKEITFSVPNDVASKFSISNGGKGMTDSNGVAIASLTGTLAGTHMIMARLANSNVSDAQPMTFVADKDRAVVVLQTSKAEIIGNGVDETTLTATVKDPSNHPVAGITVNFTMPQDVAANFTLENNGIAITQANGEAHVTLKGKKAGTHTVTATLGNNNTSDSQPVTFVADKASAQVVLQISKDEITGNGVDSATLTATVKDQFDNEVNNLPVTFSSASSGLTLTPGVSNTNESGIAQATLAGVAFGEKTVTASLANNGASDNKTVHFIGDTAAAKIIELAPVPDSIIAGTPQNSSGSVITATVVDNNGFPVKGVTVNFTSNAATAEMTNGGQAVTNEQGKATVTYTNTRSSIESGARPDTVEASLENGSSTLSTSINVNADASTAHLTLLQALFDTVSAGETTSLYIEVKDNYGNGVPQQEVTLSVSPSEGVTPSNNAIYTTNHDGNFYASFTATKAGVYQLTATLENGDSMQQTVTYVPNVANAEITLAASKDPVIADNNDLTTLTATVADTEGNAIANTEVTFTLPEDVKANFTLSDGGKVITDAEGKAKVTLKGTKAGAHTVTASMTGGKSEQLVVNFIADTLTAQVNLNVTEDNFIANNVGMTRLQATVTDGNGNPLANEAVTFTLPADVSASFTLGQGGSAITDINGKAEVTLSGTKSGTYPVTVSVNNYGVSDTKQVTLIADAGTAKLASLTSVYSFVVSTTEGATMTASVTDANGNPVEGIKVNFRGTSVTLSSTSVETDDRGFAEILVTSTEVGLKTVSASLADKPTEVISRLLNASADVNSATITSLEIPEGQVMVAQDVAVKAHVNDQFGNPVAHQPVTFSAEPSSQMIISQNTVSTNTQGVAEVTMTPERNGSYMVKASLPNGASLEKQLEAIDEKLTLTASSPLIGVYAPTGATLTATLTSANGTPVEGQVINFSVTPEGATLSGGKVRTNSSGQAPVVLTSNKVGTYTVTASFHNGVTIQTQTTVKVTGNSSTAHVASFIADPSTIAATNTDLSTLKATVEDGSGNLIEGLTVYFALKSGSATLTSLTAVTDQNGIATTSVKGAMTGSVTVSAVTTAGGMQTVDITLVAGPADTSQSVLKSNRSSLKGDYTDSAELRLVLHDISGNPIKVSEGMEFVQSGTNVPYIKISAIDYSLNINGDYKATVTGGGEGIATLIPVLNGVHQAGLSTTIQFTRAEDKIMSGTVSVNGTDLPTTTFPSQGFTGAYYQLNNDNFAPGKTAADYEFSSSASWVDVDATGKVTFKNVGSNSERITATPKSGGPSYVYEIRVKSWWVNAGEAFMIYSLAENFCSSNGYTLPRANYLNHCSSRGIGSLYSEWGDMGHYTTDAGFQSNMYWSSSPANSSEQYVVSLATGDQSVFEKLGFAYATCYKNL

SEQ ID NO: 303 - protein, 61 aa, E. Coli
MSKGALYEFNNPDQLKIPLPHKHIASTFNDIMSKDVGYAYVSLLYACPLKTHSLRLNPFSK

SEQ ID NO: 304 - protein, 398 aa, E. Coli
MQVAEQRIQLAEAQAKAVATQDGPQIDFSADMERQKMSAEGLMGPFALNDPAAGTTGPWYTNGTFGLTAGWHLDIWGKNRAEVTARLGTVKARAAEREQTRQLLAGSVARLYWEWQTQAALNTVLQQIEKEQNTIIATDRQLYQNGITSSVEGVETDINASKTRQQLNDVAGKMKIIEARLSALTNNQTKSLKLKPVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGIIAGSRVSEARIPALRERANGLLLQGQWLDASIQLTGALGGGYKR

SEQ ID NO: 305 - protein, 96 aa, E. Coli
MYCHAKLKNISQHTVISAHLFLPDYSPMNRDSFYPAIACFPLLLMLAGCAPMHETRQALSQQTPAAQVDTALPTALKMVGQTANGGWSITIINSLP

SEQ ID NO: 306 - protein, 315 aa, E. Coli
MRVLLAPMEGVLDSLVRELLTEVNDYDLCITEFVRVVDQLLPVKVFHRICPELQNASRTPSGTLVRVQLLGQFPQWLAENAARAVELGSWGVDLNCGCPSKTVNGSGGGATLLKDPELIYQGAKAMREAVPAHLPVSVKVRLGWDSGEKKFEIADAVQQAGATELVVHGRTKEQGYRAEHIDWQAIGDIRQRLNIPVIANGEIWDWQSAQQCMAISGCDAVMIGRGALNIPNLSRVVKYNEPRMPWPEVVALLQKYTRLEKQGDTGLYHVARIKQWLSYLRKEYDEATELFQHVRVLNNSPDIARAIQAIDIEKL

SEQ ID NO: 307 - protein, 296 aa, E. Coli
MTISTTSTPHDAVFKSFLRHPDTARDFIDIHLPAPLRKLCDLTTLKLEPNSFIDEDLRQYYSDLLWSVKTQEGVGYIYVVIEHQSKPEELMAFRMMRYSIAAMQNHLDAGYKELPLVLPMLFYHGCRSPYPYSLCWLDEFAEPAIARKIYSSAFPLVDITVVPDDEIMQHRKMALLELIQKHIRQRDLLGLVDQIVSLLVTGNTNDRQLKALFNYVLQTGDAQRFRAFIGEIAERAPQEKEKLMTIADRLREEGAMQGKHEEALRIAQEMLDRGLDRELVMMVTRLSPDDLIAQSH

SEQ ID NO: 308 - protein, 555 aa, E. Coli
MAQFVYTMHRVGKVVPPKRHILKNISLSFFPGAKIGVLGLNGAGKSTLLRIMAGIDKDIEGEARPQPDIKIGYLPQEPQLNPEHTVRESIEEAVSEVVNALKRLDEVYALYADPDADFDKLAAEQGRLEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGTKGRQSKGKARLARFEELNSTEYQKRNETNELFIPPGPRLGDKVLEVSNLRKSYGDRLLIDDLSFSIPKGAIVGIIGPNGAGKSTLFRMISGQEQPDSGTITLGETVKLASVDQFRDSMDNSKTVWEEVSGGLDIMKIGNTEMPSRAYVGRFNFKGVDQGKRVGELSGGERGRLHLAKLLQVGGNMLLLDEPTNDLDIETLRALENALLEFPGCAMVISHDRWFLDRIATHILDYQDEGKVEFFEGNFTEYEEYKKRTLGADALEPKRIKYKRIAK

SEQ ID NO: 309 - protein, 173 aa, E. Coli
MSKPKYPFEKRLEVVNHYFTTDDGYRIISARFGVPRTQVRTWVALYEKHGEKGLIPKPKGVSADPELRIKVVKAVIEQHMSLNQAAAHFMLAGSGSVARWLKVYEERGEAGLRALKIGTKRNIAISVDPEKAASALELSKDRRIEDLERQVRFLETRLMYLKKLKALAHPTKK

SEQ ID NO: 310 - protein, 283 aa, E. Coli
MKVLNELRQFYPLDELLRAAEIPRSTFYYHLKALSKPDKYADVKKRISEIYHENRGRYGYRRVTLSLHREGKQINHKAVQRLMGTLSLKAAIKVKRYRSYRGEVGQTAPNVLQRDFKATRPNEKWVTDVTEFAVNGRKLYLSPVIDLFNNEVISYSLSERPVMNMVENMLDQAFKKLNPHEHPVLHSDQGWQYRMRRYQNILKEHGIKQSMSRKGNCLDNAVVECFFGTLKSECFYLDEFSNISELKDAVTEYIEYYNSRRISLKLKGLTPIEYRNQTYMPRV

SEQ ID NO: 311 - protein, 38 aa, E. Coli [sequence omitted]

SEQ ID NO: 312 - protein, 443 aa, E. Coli
MAKQPGLDFQSAKGGLGELKRRLLFVIGALIVFRIGSFIPIPGIDAAVLAKLLEQQRGTIIEMFNMFSGGALSRASIFALGIMPYISASIIIQLLTVVHPTLAEIKKEGESGRRKISQYTRYGTLVLAIFQSIGIATGLPNMPGMQGLVINPGFAFYFTAVVSLVTGTMFLMWLGEQITERGIGNGISIIIFAGIVAGLPPAIAHTIEQARQGDLHFLVLLLVAVLVFAVTFFVVFVERGQRRIVVNYAKRQQGRRVYAAQSTHLPLKVNMAGVIPAIFASSIILFPATIASWFGGGTGWNWLTTISLYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYGR

SEQ ID NO: 313 - protein, 144 aa, E. Coli [sequence omitted]

SEQ ID NO: 314 - protein, 59 aa, E. Coli [sequence omitted]

SEQ ID NO: 315 - protein, 167 aa, E. Coli
MAHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILGK

SEQ ID NO: 316 - protein, 117 aa, E. Coli [sequence omitted]

SEQ ID NO: 317 - protein, 177 aa, E. Coli [sequence omitted]

SEQ ID NO: 318 - protein, 130 aa, E. Coli
MSMQDPIADMLTRIRNGQAANKAAVTMPSSKLKVAIANVLKEEGFIEDFKVEGDTKPELELTLKYFQGKAVVESIQRVSRPGLRIYKRKDELPKVMAGLGIAVVSTSKGVMTDRAARQAGLGGEIICYVA

SEQ ID NO: 319 - protein, 101 aa, E. Coli
MAKQSMKAREVKRVALADKYFAKRAELKAIISDVNASDEDRWNAVLKLQTLPRDSSPSRQRNRCRQTGRPHGFLRKFGLSRIKVREAAMRGEIPGLKKASW

SEQ ID NO: 320 - protein, 179 aa, E. Coli [sequence omitted]

SEQ ID NO: 321Z - protein, 104 aa, E. Coli [sequence omitted]

SEQ ID NO: 322 - protein, 123 aa, E. Coli [sequence omitted]

SEQ ID NO: 323 - protein, 188 aa, E. Coli
MFKGQKTLAALAVSLLFTAPVYAADEGSGEIHFKGEVIEAPCEIHPEDIDKNIDLGQVTTTHINREHHSNKVAVDIRLINCDLPASDNGSGMPVSKVGVTFDSTAKTTGATPLLSNTSAGEATGVGVRLMDKNDGNIVLGSAAPDLDLDASSSEQTLNFFAWMEQIDNAVDVTAGEVTANATYVLDYK

SEQ ID NO: 324 - protein, 427 aa, E. Coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 325 - protein, 477 aa, E. Coli
MKVTLPEFERAGVMVVGDVMLDRYWYGPTSRISPEAPVPVVKVNTIEERPGGAANVAMNIASLGANARLVGLTGIDDAARALSKSLADVNVKCDFVSVPTHPTITKLRVLSRNQQLIRLDFEEGFEGVDPQPLHERINQALSSIGALVLSDYAKGALASVQQMIQLARKAGVPVLIDPKGTDFERYRGATLLTPNLSEFEAVVGKCKTEEEIVERGMKLIADYELSALLVTRSEQGMSLLQPGKAPLHMPTQAQEVYDVTGAGDTVIGVLAATLAAGNSLEEACFFANAAAGVVVGKLGTSTVSPIELENAVRGRADTGFGVMTEEELKLAVAAARKRGEKVVMTNGVFDILHAGHVSYLANARKLGDRLIVAVNSDASTKRLKGDSRPVNPLEQRMIVLGALEAVDWVVSFEEDTPQRLIAGILPDLLVKGGDYKPEEIAGSKEVWANGGEVLVLNFEDGCSTTNIIKKIQQDKKG

SEQ ID NO: 326 - protein, 946 aa, E. Coli
MKPLSSPLQQYWQTVVERLPEPLAEESLSAQAKSVLTFSDFVQDSVIAHPEWLTELESQPPQADEWQHYAAWLQEALCNVSDEAGLMRELRLFRRRIMVRIAWAQTLALVTEESILQQLSYLAETLIVAARDWLYDACCREWGTPCNAQGEAQPLLILGMGKLGGGELNFSSDIDLIFAWPEHGCTQGGRRELDNAQFFTRMGQRLIKVLDQPTQDGFVYRVDMRLRPFGESGPLVLSFAALEDYYQEQGRDWERYAMVKARIMGDSEGVYANELRAMLRPFVFRRYIDFSVIQSLRNMKGMIAREVRRRGLTDNIKLGAGGIREIEFIVQVFQLIRGGREPSLQSRSLLPTLSAIAELHLLSENDAEQLRVAYLFLRRLENLLQSINDEQTQTLPSDELNRARLAWAMDFADWPQLTGALTAHMTNVRRVFNELIGDDESETQEESLSEQWRELWQDALQEDDTTPVLAHLSEDDRKQVLTLIADFRKELDKRTIGPRGRQVLDHLMPHLLSDVCAREDAAVTLSRITALLVGIVTRTTYLELLSEFPAALKHLISLCAASPMIASQLARYPLLLDELLDPNTLYQPTATDAYRDELRQYLLRVPEDDEEQQLEALRQFKQAQLLRIAAADIAGTLPVMKVSDHLTWLAEAMIDAVVQQAWVQMVARYGKPNHLNEREGRGFAVVGYGKLGGWELGYSSDLDLIFLHDCPMDAMTDGEREIDGRQFYLRLAQRIMHLFSTRTSSGILYEVDARLRPSGAAGMLVTSAEAFADYQKNEAWTWEHQALVRARVVYGDPQLTAHFDAVRREIMTLPREGKTLQTEVREMREKMRAHLGNKHRDRFDIKADEGGITDIEFITQYLVLRYAHEKPKLTRWSDNVRILELLAQNDIMEEQEAMALTRAYTTLRDELHHLALQELPGHVSEDCFTAERELVRASWQKWLVEE

SEQ ID NO: 327 - protein, 433 aa, E. Coli [sequence omitted]

SEQ ID NO: 328 - protein, 70 aa, E. Coli
MSGKMTGIVKWFNADKGFGFITPDDGSKDVFVHFSAIQNDGYKSLDEGQKVSFTIESGAKGPAAGNVTSL

SEQ ID NO: 329 - protein, 523 aa, E. Coli
MRDIVDPVFSIGISSLWDELRHMPAGGVWWFNVDRHEDAISLANQTIASQAETAHVAVISMDSDPAKIFQLDDSQGPEKIKLFSMLNHEKGLYYLTRDLQCSIDPHNYLFILVCANNAWQNIPAERLRSWLDKMNKWSRLNHCSLLVINPGNNNDKQFSLLLEEYRSLFGLASLRFQGDQHLLDIAFWCNEKGVSARQQLSVQQQNGIWTLVQSEEAEIQPRSDEKRILSNVAVLEGAPPLSEHWQLFNNNEVLFNEARTAQAATVVFSLQQNAQIEPLARSIHTLRRQRGSAMKILVRENTASLRATDERLLLACGANMVIPWNAPLSRCLTMIESVQGQKFSRYVPEDITTLLSMTQPLKLRGFQKWDVFCNAVNNMMNNPLLPAHGKGVLVALRPVPGIRVEQALTLCRPNRTGDIMTIGGNRLVLFLSFCRINDLDTALNHIFPLPTGDIFSNRMVWFEDDQISAELVQMRLLAPEQWGMPLPLTQSSKPVINAEHDGRHWRRIPEPMRLLDDAVERSS

SEQ ID NO: 330 - protein, 62 aa, E. Coli
MTISDIIEIIVVCALIFFPLGYLARHSLRRIRDTLRLFFAKPRYVKPAGTLRRTEKARATKK

SEQ ID NO: 331 - protein, 559 aa, E. Coli
MTQFTQNTAMPSSLWQYWRGLSGWNFYFLVKFGLLWAGYLNFHPLLNLVFAAFLLMPLPRYSLHRLRHWIALPIGFALFWHDTWLPGPESIMSQGSQVAGFSTDYLIDLVTRFINWQMIGAIFVLLVAWLFLSQWIRITVFVVAILLWLNVLTLAGPSFSLWPAGQPTTTVTTTGGNAAATVAATGGAPVVGDMPAQTAPPTTANLNAWLNNFYNAEAKRKSTFPSSLPADAQPFELLVINICSLSWSDIEAAGLMSHPLWSHFDIEFKNFNSATSYSGPAAIRLLRASCGQTSHTNLYQPANNDCYLFDNLSKLGFTQHLMMGHNGQFGGFLKEVRENGGMQSELMDQTNLPVILLGFDGSPVYDDTAVLNRWLDVTEKDKNSRSATFYNTLPLHDGNHYPGVSKTADYKARAQKFFDELDAFFTELEKSGRKVMVVVVPEHGGALKGDRMQVSGLRDIPSPSITDVPVGVKFFGMKAPHQGAPIVIEQPSSFLAISDLVVRVLDGKIFTEDNVDWKKLTSGLPQTAPVSENSNAVVIQYQDKPYVRLNGGDWVPYPQ

SEQ ID NO: 332 - protein, 127 aa, E. Coli
MEGSRMKYRIALAVSLFALSAGSYATTLCQEKEQNILKEISYAEKHQNQNRIDGLNKALSEVRANCSDSQLRADHQKKIAKQKDEVAERQQDLAEAKQKGDADKIAKRERKLAEAQEELKKLEARDY

SEQ ID NO: 333 - protein, 101 aa, E. Coli
MSKEHTTEHLRAELKSLSDTLEEVLSSSGEKSKEELSKIRSKAEQALKQSRYRLGETGDAIAKQTRVAAARADEYVRENPWTGVGIGAAIGVVLGVLLSRR

SEQ ID NO: 334 - protein, 134 aa, E. Coli
MADTHHAQGPGKSVLGIGQRIVSIMVEMVETRLRLAVVELEEEKANLFQLLLMLGLTMLFAAFGLMSLMVLIIWAVDPQYRLNAMIATTVVLLLLALIGGIWTLRKSRKSTLLRHTRHELANDRQLLEEESREQ

SEQ ID NO: 335 - protein, 99 aa, E. Coli
MSSKVERERRKAQLLSQIQQQRLDLSASRREWLETTGAYDRRWNMLLSLRSWALVGSSVMAIWTIRHPNMLVRWARRGFGVWSAWRLVKTTLKQQQLRG

SEQ ID NO: 336 - protein, 160 aa, E. Coli
MILSIDSNDANTAPLHKKTISSLSGAVESMMKKLEDVGVLVARILMPILFITAGWGKITGYAGTQQYMEAMGVPGFMLPLVILLEFGGGLAILFGFLTRTTALFTAGFTLLTAFLFHSNFAEGVNSLMFMKNLTISGGFLLLAITGPGAYSIDRLLNKKW

SEQ ID NO: 337 - protein, 296 aa, E. Coli
MIKKTTEIDAILLNLNKAIDAHYQWLVSMFHSVVARDASKPEITDNHSYGLCQFGRWIDHLGPLDNDELPYVRLMDSAHQHMHNCGRELMLAIVENHWQDAHFDAFQEGLLSFTAALTDYKIYLLTIRSNMDVLTGLPGRRVLDESFDHQLRNAEPLNLYLMLLDIDRFKLVNDTYGHLIGDVVLRTLATYLASWTRDYETVYRYGGEEFIIIVKAANDEEACRAGVRICQLVDNHAITHSEGHINITVTAGVSRAFPEEPLDVVIGRADRAMYEGKQTGRNRCMFIDEQNVINRV

SEQ ID NO: 338 - protein, 203 aa, E. Coli
MRLRVVPGFISPPPGFGGLGYTPTARACVNISIPLQLRVIDMLDVFTPLLKLFANEPLERLMYTIIIFGLTLWLIPKEFTVAFNAYTEIPWLFQIIVFAFSFVVAISFSRLRAHIQKHYSLLPEQRVLLRLSEKEIAVFKDFLKTGNLIITSPCRNPVMKKLERKGIIQHQSDSANCSYYLVTEKYSHFMKLFWNSRSRRFNR

SEQ ID NO: 339 - protein, 58 aa, E. Coli
MLLQPSARTSFGFKCFAFGIRHGSERSILVGEHAAHQGFVVAEVDFLHFANLTSCCYV

SEQ ID NO: 340 - protein, 1426 aa, E. Coli
MSGKPAARQGDMTQYGGPIVQGSAGVRIGAPTGVACSVCPGGMTSGNPVNPLLGAKVLPGETDLALPGPLPFILSRTYSSYRTKTPAPVGVFGPGWKAPSDIRLQLRDDGLILNDNGGRSIHFEPLLPGEAVYSRSESMWLVRGGKAAQPDGHTLARLWGALPPDIRLSPHLYLATNSAQGPWWILGWSERVPGAEDVLPAPLPPYRVLTGMADRFGRTLTYRREAAGDLAGEITGVTDGAGREFRLVLTTQAQRAEEARTSSLSSSDSSRPLSASAFPDTLPGTEYGPDRGIRLSAVWLMHDPAYPESLPAAPLVRYTYTEAGELLAVYDRSNTQVRAFTYDAQHPGRMVAHRYAGRPEMRYRYDDTGRVVEQLNPAGLSYRYLYEQDRITVTDSLNRREVLHTEGGAGLKRVVKKELADGSVTRSGYDAAGRLTAQTDAAGRRTEYGLNVVSGDITDITTPDGRETKFYYNDGNQLTAVVSPDGLESRREYDEPGRLVSETSRSGETVRYRYDDAHSELPATTTDATGSTRQMTWSRYGQLLAFTDCSGYQTRYEYDRFGQMTAVHREEGISLYRRYDNRGRLTSVKDAQGRETRYEYNAAGDLTAVITPDGNRSETQYDAWGKAVSTTQGGLTRSMEYDAAGRVISLTNENGSHSVFSYDALDRLVQQGGFDGRTQRYHYDLTGKLTQSEDEGLVILWYYDESDRITHRTVNGEPAEQWQYDGHGWLTDISHLSEGHRVAVHYGYDDKGRLTGECQTVENPETGELLWQHETKHAYNEQGLANRVTPDSLPPVEWLTYGSGYLAGMKLGGTPLVEYTRDRLHRETVRSFGSMAGSNAAYELTSTYTPAGQLQSQHLNSLVYDRDYGWSDNGDLVRISGPRQTREYGYSATGRLESVRTLAPDLDIRIPYATDPAGNRLPDPELHPDSTLTVWPDNRIAEDAHYVYRHDEYGRLTEKTDRIPAGVIRTDDERTHHYHYDSQHRLVFYTRIQHGEPLVESRYLYDPLGRRMAKRVWRRERDLTGWMSLSRKPEVTWYGWDGDRLTTVQTDTTRIQTVYEPGSFTPLIRVETENGEREKAQRRSLAETLQQEGSENGHGVVFPAELVRLLDRLEEEIRADRVSSESRAWLAQCGLTVEQLARQVEPEYTPARKAHLYHCDHRGLPLALISEDGNTAWSAEYDEWGNQLNEENPHHVYQPYRLPGQQHDEESGLYYNRHRYYDPLQGRYITQDPMGLKGGWNLYQYPLNPLQQIDPMGLLQTWDDARSGACTGGVCGVLSRIIGPSKFDSTADAALDALKETQNRSLCNDMEYSGIVCKDTNGKYFASKAETDNLRKESYPLKRKCPTGTDRVAAYHTHGADSHGDYVDEFFSSSDKNLVRSKDNNLEAFYLATPDGRFEALNNKGEYIFIRNSVPGLSSVCIPYHD

SEQ ID NO: 341 - protein, 122 aa, E. Coli
MKYSSIFSMLSFFILFACNETAVYGSDENIIFMRYVEKLHLDKYSVKNTVKTETMAIQLAEIYVRYRYGERIAEEEKPYLITELPDSWVVEGAKLPYEVAGGVFIIEINKKNGCVLNFLHSK

SEQ ID NO: 342 - protein, 236 aa, E. Coli
MLALMDADGNIAWSGEYDEWGNQLNEENPHHLHQPYRLPGQQYDKESGLYYNRNRYYDPLQGRYITQDPIGLEGGWSLYAYPLNPVNGIDPLGLSPADVALIRRKDQLNHQRAWDILSDTYEDMKRLNLGGTDQFFHCMAFCRVSKLNDAGVSRSAKGLGYEKEIRDYGLNLFGMYGRKVKLSHSEMIEDNKKDLAVNDHGLTCPSTTDCSDRCSDYINPEHKKTIKALQDAGYLK

SEQ ID NO: 343 - protein, 86 aa, E. Coli
MLAISSNLSKMIIFIFAIIIIVVLCVITYLYLYKDESLVSKHYINYMAIPENDGVFTWLPDFFPHVAVDISIYTNVEDDYFFLIFP

SEQ ID NO: 344 - protein, 63 aa, E. Coli
MRAREQVAKIVSKNDPDTKKVWCKYGKIPGQGDGVNLFFVGEINVTHYFITNIGAGLPDACAE

SEQ ID NO: 345 - protein, 167 aa, E. Coli
MPGNSPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 346 - protein, 91 aa, E. Coli
MASVSISCPSCSATDGVVRNGKSTAGHQRYLCSHCRKTWQLQFTYTASQPGTHQKIIDMAMNGVGCRATARIMGVGLNTILRHLKNSGRSR

SEQ ID NO: 347 - protein, 138 aa, E. Coli
MMTKTQINKLIKMMNDLDYPFEAPLKESFIESIIQIEFNSNSTNCLEKLCNEVSILFKNQPDYLTFLRAMDGFEVNGLRLFSLSIPEPSVKNLFAVNEFYRNNDDFINPDLQERLVIGDYSISIFTYDIKGDAANLLI

SEQ ID NO: 348 - protein, 392 aa, E. Coli
MSNIVYLTVTGEQQGSISAGCGTSESTGNRWQSGHEDEIFTFSLLNNINNTGLGSQFHGITFCKLIDKSTPLFINSINNNEQLFMGFDFYRINRFGRLEKYYYIQLRGAFLSAIHHQIIENQLDTETITISYEFILCQHLIANTEFSYLALPENYNRLFLPNSKNQTNNRFKTLNSKAIGRLLAAGGVYNGNIEGFRDTAEKLGGDAIKGYDQILNEKTAGIAIATASILLTKRSNVDTYTEINSYLGKLRGQQKLLDGIDIIEIIYIKRPSKDLANLRKEFNKTVRKNFLIKLAKTSEASGRFNAEDLLRMRKGNVPLNYNVHHKLSLDDGGTNDFENLVLIENEPYHKVFTNMQSRIAKGILVGESKITPWAIPSGSIYPPMKNIMDHTK

SEQ ID NO: 349 - protein, 221 aa, E. Coli
MVLALNYNMHGVNIRSENAAKPHTMPSRYLCEYIRSIEKNGHALDFGCGKLRYSDELISKFDEVTFLDSKRQLEREQIIRGIKTKIIDYVPRYYKNANTVAFEDVDKIIGGYDFILCSNVLSAVPCRDTIDKIVLSIKRLLKSGGETLIVNQYKSSYFKKYETGRKHLYGYIYKNSKSVSYYGLLDELAVQEICSSHGLEILKSWSKAGSSYVTVGSCNAI

SEQ ID NO: 350 - protein, 234 aa, E. Coli
MNNMFEPPKNYNEMLPKLHKATFLNTLIYCILLVIYEYIPLITLPTKYVPPIKDHESFINWALSFGILPCAFAIFAYLISGALDLHNNAAKLLRVRYLWDKHLIIKPLSRRAGVNRKLNKDEAHNVMSNLYYPEVRKIEDKHYIELFWNKVYYFWIFFEFSIIALISFLIIFFCKQMDIFHVEGSLLSLFFFVILSFSVSGIIFALTVKPRTESQVGKIPDDKIKEFFTKNNIN

SEQ ID NO: 351 - protein, 94 aa, E. Coli [sequence omitted]

SEQ ID NO: 352 - protein, 658 aa, E. Coli
MVLFYRAHWRDYKNDQVRIMMNLTTLTHRDALCLNARFTSREEAIHALTQRLAALGKISSTEQFLEEVYRRESLGPTALGEGLAVPHGKTAAVKEAAFAVATLSEPLQWEGVDGPEAVDLVVLLAIPPNEAGTTHMQLLTALTTRLADDEIRARIQSATTPDELLSALDDKGGTQPSASFSNAPTIVCVTACPAGIAHTYMAAEYLEKAGRKLGVNVYVEKQGANGIEGRLTADQLNSATACIFAAEVAIKESERFNGIPALSVPVAEPIRHAEALIQQALTLKRSDETRTVQQDTQPVKSVKTELKQALLSGISFAVPLIVAGGTVLAVAVLLSQIFGLQDLFNEENSWLWMYRKLGGGLLGILMVPVLAAYTAYSLADKPALAPGFAAGLAANMIGSGFLGAVVGGLIAGYLMRWVKNHLRLSSKFNGFLTFYLYPVLGTLGAGSLMLFVVGEPVAWINNSLTAWLNGLSGSNALLLGAILGFMCSFDLGGPVNKAAYAFCLGAMANGVYGPYAIFASVKMVSAFTVTASTMLAPRLFKEFEIETGKSTWLLGLAGITEGAIPMAIEDPLRVIGSFVLGSMVTGAIVGAMNIGLSTPGAGIFSLFLLHDNGAGGVMAAIGWFGAALVGAAISTAILLMWRRHAVKHGNYLTDGVMP

SEQ ID NO: 353 - protein, 877 aa, E. Coli
MKAVSRVHITPHMHWDREWYFTTEESRILLVNNMEEILCRLEQDNEYKYYVLDGQTAILEDYFAVKPENKDRVKKQVEAGKLIIGPWYTQTDTTIVSAESIVRNLMYGMRDCLAFGEPMKIGYLPDSFGMSGQLPHIYNGFGITRTMFWRGCSERHGTDKTEFLWQSSDGSEVTAQVLPLGYAIGKYLPADENGLRKRLDSYFDVLEKASVTKEILLPNGHDQMPLQQNIFEVMDKLREIYPQRKFVMSRFEEVFEKIEAQRDNLATLKGEFIDGKYMRVHRTIGSTRMDIKIAHARIENKIVNLLEPLATLAWTLGFEYHHGLLEKMWKEILKNHAHDSIGCCCSDKVHREIVARFELAEDMADNLIRFYMRKIADNMPQSDADKLVLFNLMPWPREEVINTTVRLRASQFNLRDDRGQPVPYFIRHAREIDPGLIDRQIVHYGNYDPFMEFDIQINQIVPSMGYRTLYIEANQPGNVIAAKSDAEGILENAFWQIALNEDGSLQLVDKDSGVRYDRVLQIEESSDDGDEYDYSPAKEEWVITAANAKPQCDIIHEAWQSRAVIRYDMAVPLNLSERSARQSTGRVGVVLVVTLSHNSRRIDVDINLDNQADDHRLRVLVPTPFNTDSVLADTQFGSLTRPVNDSAMNNWQQEGWKEAPVPVWNMLNYVALQEGRNGMAVFSEGLREFEVIGEEKKTFAITLLRGVGLLGKEDLLLRPGRPSGIKMPVPDSQLRGLLSCRLSLLSYTGTPTAAGVAQQARAWLTPVQCYNKIPWDVMKLNKAGFNVPESYSLLKMPPVGCLISALKKAEDRQEVILRLFNPAESATCDATVAFSREVISCSETMMDEHITTEENQGSNLSGPFLPGQSRTFSYRLA

SEQ ID NO: 354 - protein, 523 aa, E. Coli
MMLDIVELSRLQFALTAMYHFLFVPLTLGMAFLLAIMETVYVLSGKQIYKDMTKFWGKLFGINFALGVATGLTMEFQFGTNWSYYSHYVGDIFGAPLAIEGLMAFFLESTFVGLFFFGWDRLGKVQHMCVTWLVALGSNLSALWILVANGWMQNPIASDFNFETMRMEMVSFSELVLNPVAQVKFVHTVASGYVTGAMFILGISAWYMLKGRDFAFAKRSFAIAASFGMAAVLSVIVLGDESGYEMGDVQKTKLAAIEAEWETQPAPAAFTLFGIPDQEEETNKFAIQIPYALGIIATRSVDTPVIGLKELMVQHEERIRNGMKAYSLLEQLRSGSTDQAVRDQFNSMKKDLGYGLLLKRYTPNVADATEAQIQQATKDSIPRVAPLYFAFRIMVACGFLLLAIIALSFWSVIRNRIGEKKWLLRAALYGIPLPWIAVEAGWFVAEYGRQPWAIGEVLPTAVANSSLTAGDLIFSMVLICGLYTLFLVAELFLMFKFARLGPSSLKTGRYHFEQSSTTTQPAR

SEQ ID NO: 355 - protein, 379 aa, E. Coli
MIDYEVLRFIWWLLVGVLLIGFAVTDGFDMGVGMLTRFLGRNDTERRIMINSIAPHWDGNQVWLITAGGALFAAWPMVYAAAFSGFYVAMILVLASLFFRPVGFDYRSKIEETRWRNMWDWGIFIGSFVPPLVIGVAFGNLLQGVPFNVDEYLRLYYTGNFFQLLNPFGLLAGVVSVGMIITQGATYLQMRTVGELHLRTRATAQVAALVTLVCFALAGVWVMYGIDGYVVKSTMDHYAASNPLNKEVVREAGAWLVNFNNTPILWAIPALGVVLPLLTILTARMDKAAWAFVFSSLTLACIILTAGIAMFPFVMPSSTMMNASLTMWDATSSQLTLNVMTWVAVVLVPIILLYTAWCYWKMFGRITKEDIERNTHSLY

SEQ ID NO: 356 - protein, 456 aa, E. Coli
MELSSLTAVSPVDGRYGDKVSALRGIFSEYGLLKFRVQVEVRWLQKLAAHAAIKEVPAFAADAIGYLDAIVASFSEEDAARIKTIERTTNHDVKAVEYFLKEKVAEIPELHAVSEFIHFACTSEDINNLSHALMLKTARDEVILPYWRQLIDGIKDLAVQYRDIPLLSRTHGQPATPSTIGKEMANVAYRMERQYRQLNQVEILGKINGAVGNYNAHIAAYPEVDWHQFSEEFVTSLGIQWNPYTTQIEPHDYIAELFDCVARFNTILIDFDRDVWGYIALNHFKQKTIAGEIGSSTMPHKVNPIDFENSEGNLGLSNAVLQHLASKLPVSRWQRDLTDSTVLRNLGVGIGYALIAYQSTLKGVSKLEVNRDHLLDELDHNWEVLAEPIQTVMRRYGIEKPYEKLKELTRGKRVDAEGMKQFIDGLALPEEEKARLKAMTPANYIGRAITMVDELK

SEQ ID NO: 357 - protein, 61 aa, E. Coli
MLILTRRVGETLMIGDEVTVTVLGVKGNQVRIGVNAPKEVSVHREEIYQRIQAEKSQQSSY

SEQ ID NO: 358 - RNA, 93 nt, E. Coli
ggugagguggccgagaggcugaaggcgcuccccugcuaagggaguaugcggucaaaagcugcauccgggguucgaauccccgccucaccgcca

SEQ ID NO: 359 - protein, 200 aa, E. Coli
MKNKADNKKRNFLTHSEIESLLKAANTGPHAARNYCLTLLCFIHGFRASEICRLRISDIDLKAKCIYIHRLKKGFSTTHPLLNKEVQALKNWLSIRTSYPHAESEWVFLSRKGNPLSRQQFYHIISTSGGNAGLSLEIHPHMLRHSCGFALANMGIDTRLIQDYLGHRNIRHTVWYTASNAGRFYGIWDRARGRQRHAVL

SEQ ID NO: 360 - protein, 198 aa, E. Coli
MSKRRYLTGKEVQAMMQAVCYGATGARDYCLILLAYRHGMRISELLDLHYQDLDLNEGRINIRRLKNGFSTVHPLRFDEREAVERWTQERANWKGADRTDAIFISRRGSRLSRQQAYRIIRDAGIEAGTVTQTHPHMLRHACGYELAERGADTRLIQDYLGHRNIRHTVRYTASNAARFAGLWERNNLINEKLKREEV

SEQ ID NO: 361 - protein, 182 aa, E. Coli
MKIKTLAIVVLSALSLSSTAALAAATTVNGGTVHFKGEVVNAACAVDAGSVDQTVQLGQVRTASLAQEGATSSAVGFNIQLNDCDTNVASKAAVAFLGTAIDAGHTNVLALQSSAAGSATNVGVQILDRTGAALTLDGATFSSETTLNNGTNTIPFQARYFATGAATPGAANADATFKVQYQ

SEQ ID NO: 362 - protein, 215 aa, E. Coli
MLLMRMRPSRFSINNLPRFRDVITGRDAHPCAIKITMKRKRLFLLASLLPMFALAGNKWNTTLPGGNMQFQGVIIAETCRIEAGDKQMTVNMGQISSNRFHAVGEDSAPVPFVIHLRECSTVVSERVGVAFHGVADGKNPDVLSVGEGPGIATNIGVALFDDEGNLVPINRPPANWKRLYSGSTSLHFIAKYRATGRRVTGGIANAQAWFSLTYQ

SEQ ID NO: 363 - protein, 241 aa, E. Coli
MSNKNVNVRKSQEITFCLLAGILMFMAMMVAGRAEAGVALGATRVIYPAGQKQEQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 364 - protein, 878 aa, E. Coli
MSYLNLRLYQRNTQCLHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKTRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 365 - protein, 176 aa, E. Coli
MRNKPFYLLCAFLWLAVSHALAADSTITIRGYVRDNGCSVAAESTNFTVDLMENAAKQFNNIGATTPVVPFRILLSPCGNAVSAVKVGFTGVADSHNANLLALENTVSAASGLGIQLLNEQQNQIPLNAPSSALSWTTLTPGKPNTLNFYARLMATQVPVTAGHINATATFTLEYQ

SEQ ID NO: 366 - protein, 167 aa, E. Coli
MKWCKRGYVLAAILALASATIQAADVTITVNGKVVAKPCTVSTTNATVDLGDLYSFSLMSAGAASAWHDVALELTNCPVGTSRVTASFSGAADSTGYYKNQGTAQNIQLELQDDSGNTLNTGATKTVQVDDSSQSAHFPLQVRALTVNGGATQGTIQAVISITYTYS

SEQ ID NO: 367 - protein, 300 aa, E. Coli
MKRVITLFAVLLMGWSVNAWSFACKTANGTAIPIGGGSANVYVNLAPVVNVGQNLVVDLSTQIFCHNDYPETITDYVTLQRGSAYGGVLSNFSGTVKYSGSSYPFPTTSETPRVVYNSRTDKPWPVALYLTPVSSAGGVAIKAGSLIAVLILRQTNNYNSDDFQFVWNIYANNDVVVPTGGCDVSARDVTVTLPDYPGSVPIPLTVYCAKSQNLGYYLSGTTADAGNSIFTNTASFSPAQGVGVQLTRNGTIIPANNTVSLGAVGTSAVSLGLTANYARTGGQVTAGNVQSIIGVTFVYQ

SEQ ID NO: 368 - protein, 521 aa, E. Coli
MLSKLPRRLRSFQTYCTIRVHRGEDMKSMDKLTTGVAYGTSAGNAGFWALQLLDKVTPSQWAAIGVLGSLVFGLLTYLTNLYFKIKEDRRKAARGESNDSRLTGCERSPFESYGNCSLTGQRTLRNFPGCRHGPCRSCAGVLGSSQKERPASLPGSSRKIVRKSVLSAASVLLDKSCQARASSSISMNTKIRYGLSAAVLALIGAGASAPQILDQFLDEKEGNHTMAYRDGSGIWTICRGATVVDGKTVFPNMKLSKEKCDQVNAIERDKALAWVERNIKVPLTEPQKAGIASFCPYNIGPGKCFPSTFYKRLNAGDRKGACEAIRWWIKDGGRDCRIRSNNCYGQVIRRDQESALTCWGIEQIRYSWFFSCCQDLSSEMSGATEDGKKNGRNVMLPHYHKRMLNLLLELNRGELPVMRLLKMRNRNLLKFLPGLLICLIVLTSCVPKQKNMPYALTQRSIPQILPLPSEAKQPKPPKECSPTCSEILQQKLSFMLKLLTNATSQELVNRSMNLEIKSIKC

SEQ ID NO: 369 - protein, 177 aa, E. Coli
MNTKIRYGLSAAVLALIGAGASAPQILDQFLDEKEGNHTMAYRDGSGIWTICRGATVVDGKTVFPNMKLSKEKCDQVNAIERDKALAWVERNIKVPLTEPQKAGIASFCPYNIGPGKCFPSTFYKRLNAGDRKGACEAIRWWIKDGGRDCRIRSNNCYGQVIRRDQESALTCWGIEQ

SEQ ID NO: 370 - protein, 103 aa, E. Coli
MTQDYELVVKGVRNFENKVTVTVALQDKERFDGEIFDLDVAMDRVEGAALEFYEAAARRSVRQVFLEVAEKLSEKVESYLQHQYSFKIENPANKHERPHHKYL

SEQ ID NO: 371 - protein, 96 aa, E. Coli
MLSKLPRRLRSFQTYCTIRVHRGEDMKSMDKLTTGVAYGTSAGNAGFWALQLLDKVTPSQWAAIGVLGSLVFGLLTYLTNLYFKIKEDRRKAARGE

SEQ ID NO: 372 - protein, 71 aa, E. Coli
MSNKMTGLVKWFNADKGFGFISPVDGSKDVFVHFSAIQNDNYRTLFEGQKVTFSIESGAKGPAAANVIITD

SEQ ID NO: 373 - protein, 338 aa, E. Coli
MFVIWSHRTGFIMSHQLTFADSEFSSKRRQTRKEIFLSRMEQILPWQNMVEVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSTKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVRTLKQHPRKNKTAINIEYMKASIRARVEHPFRIIKRQFGFVKARYKGLLKNDNQLAMLFTLANLFRADQMIRQWERSH

SEQ ID NO: 374 - protein, 157 aa, E. Coli
MVYIIIVSHGHEDYIKKLLENLNADDEHYKIIVRDNKDSLLLKQICQHYAGLDYISGGVYGFGHNNNIAVAYVKEKYRPADDDYILFLNPDIIMKHDDLLTYIKYVESKRYAFSTLCLFRDEAKSLHDYSVRKFPVLSDFIVSFMLGIKEGANKSLI

SEQ ID NO: 375 - protein, 372 aa, E. Coli
MGKSIVVVSAVNFTTGGPFTILKKFLAATNNKENVSFIALVHSAKELKESYPWVKFIEFPEVKGSWLKRLHFEYVVCKKLSKELNATHWICLHDITANVVTKKRYVYCHNPAPFYKGILFREILMEPSFFLFKMLYGLIYKINIKKNTAVFVQQFWMKEKFIKKYSINNIIVSRPEIKLSDKSQLTDDDSQFKNNPSELTIFYPAVPRVFKNYELIISAARKLKEQSNIKFLLTISGTENAYAKYIISLAEGLDNVHFLGYLDKEKIDHCYNISDIVCFPSRLETWGLPLSEAKERGKWVLASDFPFTRETLGSYEKKAFFDSNNDDMLVKLIIDFKKGNLKKDISDANFIYRNENVLVGFDELVNFITEEH

SEQ ID NO: 376 - protein, 196 aa, E. Coli
MILKLAKRYGLCGFIRLVRDVLLTRVFYRNCRIIRFPCYIRNDGSINFGENFTSGVGLRLDAFGRGVIFFSDNVQVNDYVHIASIESVTIGRDTLIASKVFITDHNHGSFKHSDPMSSPNIPPDMRTLESSAVVIGQRVWLGENVTVLPGTIIGNGVVVGANSVVRGSIPENTVIAGVPAKIIKKYNHETKLWEKA

SEQ ID NO: 377 - protein, 330 aa, E. Coli
MYFLNDLNFSRRDAGFKARKDALDIASDYENISVVNIPLWGGVVQRIISSVKLSTFLCGLENKDVLIFNFPMAKPFWHILSFFHRLLKFRIVPLIHDIDELRGGGGSDSVRLATCDMVISHNPQMTKYLSKYMSQDKIKDIKIFDYLVSSDVEHRDVTDKQRGVIYAGNLSRHKCSFIYTEGCDFTLFGVNYENKDNPKYLGSFDAQSPEKINLPGMQFGLIWDGDSVETCSGAFGDYLKFNNPHKTSLYLSMELPVFIWDKAALADFIVDNRIGYAVGSIKEMQEIVDSMTIETYKQISENTKIISQKIRTGSYFRDVLEEVIDDLKTR

SEQ ID NO: 378 - protein, 388 aa, E. Coli
MIYLVISVFLITAFICLYLKKDIFYPAVCVNIIFALVLLGYEITSDIYAFQLNDATLIFLLCNVLTFTLSCLLTESVLDLNIRKVNNAIYSIPSKKVHNVGLLVISFSMIYICMRLSNYQFGTSLLSYMNLIRDADVEDTSRNFSAYMQPIILTTFALFIWSKKFTNTKVSKTFTLLVFIVFIFAIILNTGKQIVFMVIISYAFIVGVNRVKHYVYLITAVGVLFSLYMLFLRGLPGGMAYYLSMYLVSPIIAFQEFYFQQVSNSASSHVFWFFERLMGLLTGGVSMSLHKEFVWVGLPTNVYTAFSDYVYISAELSYLMMVIHGCISGVLWRLSRNYISVKIFYSYFIYTFSFIFYHESFMTNISSWIQITLCIIVFSQFLKAQKIK

SEQ ID NO: 379 - protein, 367 aa, E. Coli [sequence omitted]

SEQ ID NO: 380 - protein, 371 aa, E. Coli
MFPKIMNDENFFKKAAAHGEEPPLTPQNEHQRSGLRFARRVRLPRAVGLAGMFLPIASTLVSHPPPGWWWLVLVGWAFVWPHLAWQIASRAVDPLSREIYNLKTDAVLAGMWVGVMGVNVLPSTAMLMIMCLNLMGAGGPRLFVAGLVLMVVSCLVTLELTGITVSFNSAPLEWWLSLPIIVIYPLLFGWVSYQTATKLAEHKRRLQVMSTRDGMTGVYNRRHWETMLRNEFDNCRRHNRDATLLIIDIDHFKSINDTWGHDVGDEAIVALTRQLQITLRGSDVIGRFGGDEFAVIMSGTPAESAITAMLRVHEGLNTLRLPNTPQVTLRISVGVAPLNPQMSHYREWLKSADLALYKAKKAGRNRTEVAA

SEQ ID NO: 381 - protein, 467 aa, E. Coli
MDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 382 - protein, 222 aa, E. Coli
MPVKDLTGITAKDAQMLSVVKPLQEFGKLDKCLSRYGTRFEFNNEKQVIFSSDVNNEDTFVILEGVISLRREENVLIGITQAPYIMGLADGLMKNDIPYKLISEGNCTGYHLPAKQTITLIEQNQLWRDAFYWLAWQNRILELRDVQLIGHNSYEQIRATLLSMIDWNEELRSRIGVMNYIHQRTRISRSVVAEVLAALRKGGYIEMNKGKLVAINRLPSEY

SEQ ID NO: 383 - protein, 84 aa, E. Coli
MTDKIRTLQGRVVSDKMEKSIVVAIERFVKHPIYGKFIKRTTKLHVHDENNECGIGDVVEIRECRPLSKTKSWTLVRVVEKAVL

SEQ ID NO: 384 - protein, 63 aa, E. Coli [sequence omitted]

SEQ ID NO: 385 - protein, 136 aa, E. Coli [sequence omitted]

SEQ ID NO: 386 - protein, 233 aa, E. Coli
MGQKVHPNGIRLGIVKPWNSTWFANTKEFADNLDSDFKVRQYLTKELAKASVSRIVIERPAKSIRVTIHTARPGIVIGKKGEDVEKLRKVVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQPEKPAAQPKKQQRKGRK

SEQ ID NO: 387 - protein, 110 aa, E. Coli [sequence omitted]

SEQ ID NO: 388 - protein, 92 aa, E. Coli
MPRSLKKGPFIDLHLLMKVEKAVESGDKKPLRTWSRRSTIFPNMIGLTIAVHNGRQHVPVFVTDEMVGHKLGEFAPTRTYRGHAADKKAKKK

SEQ ID NO: 389 - protein, 273 aa, E. Coli [sequence omitted]

SEQ ID NO: 390 - protein, 100 aa, E. Coli [sequence omitted]

SEQ ID NO: 391 - protein, 201 aa, E. Coli [sequence omitted]

SEQ ID NO: 392 - protein, 209 aa, E. Coli [sequence omitted]

SEQ ID NO: 393 - protein, 103 aa, E. Coli
MQNQRIRIRLKAFDHRLIDQATAEIVETAKRTGAQVRGPIPLPTRKERFTVLISPHVNKDARDQYEIRTHLRLVDIVEPTEKTVDALMRLDLAAGVDVQISLG

SEQ ID NO: 394 - protein, 118 aa, E. Coli [sequence omitted]

SEQ ID NO: 395 - protein, 65 aa, E. Coli [sequence omitted]

SEQ ID NO: 396 - protein, 180 aa, E. Coli
MKGGKRVQTARPNRINGEIRAQEVRLTGLEGEQLGIVSLREALEKAEEAGVDLVEISPNAEPPVCRIMDYGKFLYEKSKSSKEQKKKQKVIQVKEIKFRPGTDEGDYQVKLRSLIRFLEEGDKAKITLRFRGREMAHQQIGMEVLNRVKDDLQELAVVESFPTKIEGRQMIMVLAPKKKQ

SEQ ID NO: 397 - protein, 642 aa, E. Coli
MPVITLPDGSQRHYDHAVSPMDVALDIGPGLAKACIAGRVNGELVDACDLIENDAQLSIITAKDEEGLEIIRHSCAHLLGHAIKQLWPHTKMAIGPVIDNGFYYDVDLDRTLTQEDVEALEKRMHELAEKNYDVIKKKVSWHEARETFANRGESYKVSILDENIAHDDKPGLYFHEEYVDMCRGPHVPNMRFCHHFKLMKTAGAYWRGDSNNKMLQRIYGTAWADKKALNAYLQRLEEAAKRDHRKIGKQLDLYHMQEEAPGMVFWHNDGWTIFRELEVFVRSKLKEYQYQEVKGPFMMDRVLWEKTGHWDNYKDAMFTTSSENREYCIKPMNCPGHVQIFNQGLKSYRDLPLRMAEFGSCHRNEPSGSLHGLMRVRGFTQDDAHIFCTEEQIRDEVNGCIRLVYDMYSTFGFEKIVVKLSTRPEKRIGSDEMWDRAEADLAVALEENNIPFEYQLGEGAFYGPKIEFTLYDCLDRAWQCGTVQLDFSLPSRLSASYVGEDNERKVPVMIHRAILGSMERFIGILTEEFAGFFPTWLAPVQVVIMNITDSQSEYVNELTQKLSNAGIRVKADLRNEKIGFKIREHTLRRVPYMLVCGDKEVESGKVAVRTRRGKDLGSMDVNEVIEKLQQEIRSRSLKQLEE

SEQ ID NO: 398 - protein, 450 aa, E. Coli
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 399 - RNA, 2904 nt, E. Coli
aagguuaagccucacgguucauuaguaccgguuagcucaacgcaucgcugcgcuuacacacccggccuaucaacgucgucgucuucaacguuccuucaggacccuuaaagggucagggagaacucaucucggggcaaguuucgugcuuagaugcuuucagcacuuaucucuuccgcauuuagcuaccgggcagugccauuggcaugacaacccgaacaccagugaugcguccacuccgguccucucguacuaggagcagccccccucaguucuccagcgcccacggcagauagggaccgaacugucucacgacguucuaaacccagcucgcguaccacuuuaaauggcgaacagccauacccuugggaccuacuucagccccaggaugugaugagccgacaucgaggugccaaacaccgccgucgauaugaacucuugggcgguaucagccuguuauccccggaguaccuuuuauccguugagcgauggcccuuccauucagaaccaccggaucacuaugaccugcuuucgcaccugcucgcgccgucacgcucgcagucaagcuggcuuaugccauugcacuaaccuccugauguccgaccaggauuagccaaccuucgugcuccuccguuacucuuuaggaggagaccgccccagucaaacuacccaccagacacuguccgcaacccggauuacgggucaacguuagaacaucaaacauuaaagggugguauuucaaggucggcuccaugcagacuggcguccacacuucaaagccucccaccuauccuacacaucaaggcucaauguucagugucaagcuauaguaaagguucacggggucuuuccgucuugccgcggguacacugcaucuucacagcgaguucaauuucacugagucucggguggagacagccuggccaucauuacgccauucgugcaggucggaacuuacccgacaaggaauuucgcuaccuuaggaccguuauaguuacggccgccguuuaccggggcuucgaucaagagcuucgcuugcgcuaaccccaucaauuaaccuuccggcaccgggcaggcgucacaccguauacguccacuuucguguuugcacagugcuguguuuuuaauaaacaguugcagccagcugguaucuucgacugauuucagcuccauccgcgagggaccucaccuacauaucagcgugccuucucccgaaguuacggcaccauuuugccuaguuccuucacccgaguucucucaagcgccuugguauucucuaccugaccaccugugucgguuugggguacgauuugauguuaccugaugcuuagaggcuuuuccuggaagcagggcauuuguugcuucagcaccguagugccucgucaucacgccucagccuugauuuuccggauuugccuggaaaaccagccuacacgcuuaaaccgggacaaccgucgcccggccaacauagccuucuccguccccccuucgcaguaacaccaaguacaggaauauuaaccuguuucccaucgacuacgccuuucggccucgccuuaggggucgacucacccugccccgauuaacguuggacaggaacccuuggucuuccggcgagcgggcuuuucacccgcuuuaucguuacuuaugucagcauucgcacuucugauaccuccagcaugccucacagcacaccuucgcaggcuuacagaacgcuccccuacccaacaacgcauaagcgucgcugccgcagcuucggugcaugguuuagccccguuacaucuuccgcgcaggccgacucgaccagugagcuauuacgcuuucuuuaaaugauggcugcuucuaagccaacauccuggcugucugggccuucccacaucguuucccacuuaaccaugacuuugggaccuuagcuggcggucuggguuguuucccucuucacgacggacguuagcacccgccgugugucucccgugauaacauucuccgguauucgcaguuugcaucggguugguaagucgggaugacccccuugccgaaacagugcucuacccccggagaugaauucacgaggcgcuaccuaaauagcuuucggggagaaccagcuaucucccgguuugauuggccuuucacccccagccacaagucauccgcuaauuuuucaacauuagucgguucgguccuccaguuaguguuacccaaccuucaaccugcccauggcuagaucaccggguuucgggucuauacccugcaacuuaacgcccaguuaagacucgguuucccuucggcuccccuauucgguuaaccuugcuacagaauauaagucgcugacccauuauacaaaagguacgcagucacacgccuaagcgugcucccacugcuuguacguacacgguuucagguucuuuuucacuccccucgccgggguucuuuucgccuuucccucacgguacugguucacuaucggucagucaggaguauuuagccuuggaggaugguccccccauauucagacaggauaccacgugucccgcccuacucaucgagcucacagcaugugcauuuuuguguacggggcugucacccuguaucgcgcgccuuuccagacgcuuccacuaacacacacacugauucaggcucugggcugcuccccguucgcucgccgcuacugggggaaucucgguugauuucuuuuccucgggguacuuagauguuucaguucccccgguucgccucauuaaccuauggauucaguuaaugauagugugucgaaacacacuggguuuccccauucggaaaucgccgguuauaacgguucauaucaccuuaccgacgcuuaucgcagauuagcacguccuucaucgccucugacugccagggcauccaccguguacgcuuagucgcuuaacc

SEQ ID NO: 400 - RNA, 120 nt, E. Coli
augccuggcaguucccuacucucgcauggggagaccccacacuaccaucggcgcuacggcguuucacuucugaguucggcauggggucaggugggaccaccgcgcuacggccgccaggca

SEQ ID NO: 401 - RNA, 76 nt, E. Coli
guccccuucgucuagaggcccaggacaccgcccuuucacggcgguaacagggguucgaauccccuaggggacgcca

SEQ ID NO: 402 - RNA, 1549 nt, E. Coli
aaauugaagaguuugaucauggcucagauugaacgcuggcggcaggccuaacacaugcaagucgaacgguaacaggaagcagcuugcugcuucgcugacgaguggcggacgggugaguaaugucugggaagcugccugauggagggggauaacuacuggaaacgguagcuaauaccgcauaaugucgcaagaccaaagagggggaccuucgggccucuugccaucggaugugcccagaugggauuagcuuguuggugggguaacggcucaccaaggcgacgaucccuagcuggucugagaggaugaccagccacacuggaacugagacacgguccagacuccuacgggaggcagcaguggggaauauugcacaaugggcgcaagccugaugcagccaugccgcguguaugaagaaggccuucggguuguaaaguacuuucagcggggaggaagggaguaaaguuaauaccuuugcucauugacguuacccgcagaagaagcaccggcuaacuccgugccagcagccgcgguaauacggagggugcaagcguuaaucggaauuacugggcguaaagcgcacgcaggcggguugguuaagucagaugugaaauccccgggcucaaccugggaacugcaucugauacuggcaagcuugagucucguagagggggguagaauuccagguguagcggugaaaugcguagagaucuggaggaauaccgguggcgaaggcggcccccuggacgaagacugacgcucaggugcgaaagcguggggagcaaacaggauuagauacccugguaguccacgccguaaacgaugucgacuuggagguugugcccuugaggcguggcuuccggagcuaacgcguuaagucgaccgccuggggaguacggccgcaagguuaaaacucaaaugaauugacgggggcccgcacaagcgguggagcaugugguuuaauucgaugcaacgcgaagaaccuuaccuggucuugacauccacggaaguuuucagagaugagaaugugccuucgggaaccgugagacaggugcugcauggcugucgucagcucguguugugaaauguuggguuaagucccgcaacgagcgcaacccuuauccuuuguugccagcgguccggccgggaacucaaaggagacugccagugauaaacuggaggaagguggggaugacgucaagucaucauggcccuuacgaccagggcuacacacgugcuacaauggcgcauacaaagagaagcgaccucgcgagagcaagcggaccucauaaagugcgucguaguccggauuggagucugcaacucgacuccaugaagucggaaucgcuaguaaucguggaucagaaugccacggugaauacguucccgggccuuguacacaccgcccgucacaccaugggaguggguugcaaaagaaguagguagcuuaaccuucgggagggcgcuuaccacuuugugauucaugacuggggugaagucguaacaagguaaccguaggggaaccugcgguuggaucaccuccuuaccuuaa

SEQ ID NO: 403 - DNA, 17 bp, Artificial Sequence
  Primer Oligonucleotide
tgtttatcagaccgctt

SEQ ID NO: 404 - DNA, 18 bp, Artificial Sequence
  Primer Oligonucleotide
acaatttcacacagcctc

SEQ ID NO: 405 - DNA, 159 bp, Escherichia coli; identical to SEQ ID NO: 1

SEQ ID NO: 406 - DNA, 640 bp, Escherichia coli
  misc_feature (1)...(640): n = A,T,C or G
ggggnccaaagtgtttgggncgggcaactggaggccaaccttaanttnggggaaatttttaanaaaaggcggggatttgtnagccacgggngattantttanaataaattaagtgttgccataaggggacaaagngaaggaagtggntattaangganncgccaatgcganttagggcagaccattcggccattcgccttcttggttatcgaagttcatccagatagccgttgccngaccgaccagattcgcttcnggcacaaagccccagtaacggctgtccgcgctgttgtcgcggttgtcgcccatcatgaagtattgtcccggaggaacaatccaggttgccagttgttgccctggctgctggtaatacatccccacctgatcctgcgcaatcggcactgtcagaatgcggtgcgtcacatcacccagtgtctctttacgctcggaaagacgaattccattttctttggtttcgtttttcggcacttcaaagaatccgctggtcgcttccccaccattacggcgtgagaaggtctgaacgaaatcgctcggttccacgtttgagtaggtgaccggcagcgcgttttcacacgcctggccggaactgcatcccggttgaatcgtcagctcttttgag

SEQ ID NO: 407 - DNA, 682 bp, Escherichia coli
  misc_feature (1)...(682): n = A,T,C or G
cctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcnattataccngtaaccggcactacagcacacgtagaaagcacccgacaatactcctggcatgggcgttaaagctcacaggatggagatcttttcttcactggcctaaaaagctgatattctgtaaagagttacacngtaacattgagatcgctatgaaatatcaacaacttggaaaatcttgnaaagcnggttggaaaatggaaagtatctggttaagaagc

SEQ ID NO: 408 - DNA, 309 bp, Escherichia coli
ggggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcagccaagctt

SEQ ID NO: 409 - DNA, 1167 bp, Escherichia coli
gtcgacccatctgtccattgagcggacagtttgtgcaacactattttgttgaccggaaaatggaacactttccgcaatgcctgttgctatcacgcttaaaccatttcattgcgatttacacagaacggacgtcctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcgccacgtactgctttgataacagcaactttgttagcgccagcagctttcagaattacgtcgaattcagttttttcttcagcagcttcaaccgggccagcagctacagctacagcagcagcagcggaaacaccgaatttttcttycattgcagagatcaagttctacaacgtccattacagacatagctgcaactgcttcaatgawttgatctttagtgatagacatttaaatkgttcctgaatatcagaataagtttatacgtaagcgaatgcgttaaaaagataactgcgawtaagcagcttytttcgcatcgcgtacagmagccagagtacgaaccagtttgccagccgaagcttctttcatggttgccatcaggcgtgcaattgcttcttcgtaggtcggcagagttgccaggcggtcgatctgagacgccgggatcagctcaccttcaaaggcagcggctttgacctcaaattttgcattcgctttcgcgaactctttgaacagacgagcagcagcgcccgggtgttccatagagtatgcaatcagggtcggaccaacaaacgcgtctttcaggcactcgaacggagtaccttcaacagcacggcgcagcagggtgttacgaacaacacgcatgtatacgccagcttcgcgacctgctttacgcagttcagtcattttatctacagttacgcccacgggaatccgcaactactgcaagccaagctt

SEQ ID NO: 410 - DNA, 404 bp, Escherichia coli
caacmctattttgktggaccggaaaakggaacactttccgcawkgcctgttgctatcacgcttaaaccatttcattgcgatttacacagaacggacgtcctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcg

SEQ ID NO: 411 - DNA, 152 bp, Escherichia coli
agagcttttttcagtgcttctgcgtcgtctttgctcacgccttctttcaagagcagcccggtgcagattctaccaggtctttagcttctttcagacccaggccagttgcgccacgtactgctttgataacagcaactttgttagcgccagca

SEQ ID NO: 412 - DNA, 825 bp, Escherichia coli
  misc_feature (1)...(825): n = A,T,C or G
gatccgtcgacccatctgtccattgagcggacagtttgtgcaacactattttgttgaccggaaaatggaacactttccgcaatgcctgttgctatcacgcttaamccatttcattgcgatttacacagaacggacgtcctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagcttttttcagtgcttctgcgtcgtctttgctcacgccttctttcagagcagccgggtgcagattctaccaggtctttagcttctttcagacccaggccagttgcgccacgtactgctttgataacagcaactttgttagcgccagcagctttcagaattacgtcgaattcaagttttttcttcagcagcttcaaccgggccagcagctacagctacagcagcagcagcggaaacaccgaatttttcttycattggcagagatcaagttctacaacgtccattacagacatagctgcaactgcttcaatgattkgatcttwagtgatagacatttaaattgttcctgaatatcagaataagtttatacgtaagcgaatgcgttaaaaagataactgcgattaagcagcttctttcgcatcgcgtacagcagccagaggtcgaaccagtttgccagccgaaggttggcttttcagcctnnncnnatta

SEQ ID NO: 413 - DNA, 425 bp, Escherichia coli
agtagtcaaacaggtgkgraacgctactggcgccttacagcgcaaaaaggctggtgactaaaaagtcaccagccatcarcctgatttctcaggctgcaacccggaagggttggcttatttaacttcaacttcagcgccagcttcttccagagcttttttcagtgcttctgcgtcgtctttgctcacgccttctttcagagcagccggtgcagattctaccaggtctttagcttctttcagacccaggccagttgcgccacgtactgctttgataacagcaactttgttagcgccagcagctttcagaattacgtcgaattcagttttttcttcagcagcttcaaccgggccagcagctacagctacagcagcagcagcggaaacacccgaatttttcttccattgcagagatcaagttctacaac

SEQ ID NO: 414 - DNA, 126 bp, Escherichia coli
agagcttttttcagtgcttctgcgtcgtctttgctcacgccttctttcagagcagccggtgcagattctaccaggtctttagcttctttcagacccaggccagttgcgccacgtactgctttrata

SEQ ID NO: 415 - DNA, 264 bp, Escherichia coli
ctgcmacccggargggttggcttatttaacttcaacttcagcgccagcttcttycagagcttttttcaagtgcttctgcgtcgtctttgctcacgccttctttcagagcagccggtgcagattctaccaggtctttagcttctttcagacccaggccagttgcgccacgtactgctttgataacagcaactttgttagcgccagcagctttcagaattacgtcgaattcagttttttcttcagcagcttcaaccgggccagcag

SEQ ID NO: 416 - DNA, 201 bp, Escherichia coli
cgcataccctgcagcatcggcccgatggagatcaggtcggcagaacgctgtaccgctttgtaggtggtgttaccggtgttcagatccgggaagatgaacacggtagcgcgacctgcaaccggagagttcggcgctttggatttcgcaacgtcagccattaccgcagcgtcgtactgcagcggaccgtcgatcatcaggtca

SEQ ID NO: 417 - DNA, 239 bp, Escherichia coli
aattcagcagttgacagtggcataaacgtaactggtgacttttgcccggcatgacgccgggctttttttattattccgtgacttccagcgtagtgaaggcaaacttctcgccatcaaatagcccctgactggttagttttagcgcggggatcactggcagagaaagaaacgccatctgaataaacggctcatcgggtaacggaccgcattcacgggcggcggctttcaaggcgtcaatt

SEQ ID NO: 418 - DNA, 223 bp, Escherichia coli
ttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttg

SEQ ID NO: 419 - DNA, 223 bp, Escherichia coli; identical to SEQ ID NO: 418

SEQ ID NO: 420 - DNA, 212 bp, Escherichia coli
aatagcgggtatgcacgcctttctttttttcgtcaacggtgtccagaatcattttatttacctcgggtacttatgctgatttttattattatggggaaggtgttatttatgagtttcatttatgccgtaacgmcaatgaactcgggaattagtataagcagcgcgagaataataatcattgtgcaaatgctaatttaattaatactatttaa

SEQ ID NO: 421 - DNA, 438 bp, Escherichia coli
ccctgtaaattatcgcccgtggcataaaaactgcgtccaaacgccgtctttgccagcagccaggccataaatgccaccagaattatcgtcaaccaaccaattgctgaaacgccaagcagcagcggggcggagagctgtttcagttcggcgggtaacccttcaatccatttgccgccagtccacagcaacatgatgcctctgtacaaccctaacgtgccaagggtggcaacaatggcagggatctttagccacgcgaccaggacaccgttgaaaaatcccgcgagcaaaccaagcagtaaagtcgcgacacaagcaacaggtagtgaatatcctgcgttcagtaacatccccaacagcaccgcgcacattccgggtaatcgaaccccacttgaaacatcaatattgsgsgtaagcattwccaagcgttcgsgcccatkg

SEQ ID NO: 422 - DNA, 682 bp, Escherichia coli
aattcccggggatccgtcgaccgtgcgcttccggttgtggcaacccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcaggagtgatgactgcagc

SEQ ID NO: 423 - DNA, 600 bp, Escherichia coli
ggggatccgattgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacgggagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcaggagtgtatgactgcagcaaccgaacagaaaattcccggtaactgttacccggtcgataaagttattcaccaggataatatcgaaatcccggcaggtctttaaacagttccgtaataaataa

SEQ ID NO: 424 - DNA, 100 bp, Escherichia coli
gggatccagcaagaagatgcggttgtaccgtcatcacgcagatgcgcaaagctactcagcaactgacctttcttcgcaataagcacgccattagcgtcat

SEQ ID NO: 425 - DNA, 465 bp, Escherichia coli; identical to SEQ ID NO: 21

SEQ ID NO: 426 - DNA, 653 bp, Escherichia coli
  misc_feature (1)...(653): n = A,T,C or G
tgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgccatacccgcgatgatggctgggtagattcttcgtcagtccatacacggnaagacgggtcttntttagccagacgggccagagncagacccatttttttctggcagctttggnttcggtcaactgcgatggaaatacccggctcaaggaattcatacgtttcanaatgatcggggcattccgggtcaca

SEQ ID NO: 427 - DNA, 268 bp, Escherichia coli
ctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataac

SEQ ID NO: 428 - DNA, 330 bp, Escherichia coli; identical to SEQ ID NO: 24

SEQ ID NO: 429 - DNA, 465 bp, Escherichia coli
gttttggggagatgtaagggctaatctgaatggctgcattccttgtttaaggaaaaacgaatgactgattgccgatacctgattaaacgggtcatcaaaatcatcattgctgttttacagctgatccttctgttcttataacacaaggaaacgtacttaaggtgcgtccggtgaaccagtcggacgcacctttaataactataaataagtgtctgggcagatactatataaattaacttagtgaatgattatgctaatgtcatcaattaaataaatataatggcgttaaggcttcccagtaatataattaatactctacttccagagtagaatattaaattttatccgcgtggtgcatcagcacaaatttatcccacaactgttcttctgtctcgacatgcgccggatctttcacaatagtattggggatcgggcacaccttctggcaggttggtgtctcgtagt

SEQ ID NO: 430 - DNA, 379 bp, Escherichia coli
aatctgaatggctgcattccttgtttaaggaaaaacgaatgactgattgccgatacctgattaaacgggtcatcaaaatcatcattgctgttttacagctgatccttctgttcttataacacaaggaaacgtacttaaggtgcgtccggtgaaccagtcggacgcacctttaataactataaataagtgtctgggcagatactatataaattaacttagtgaatgattatgctaatgtcatcaattaaataaatataatggcgttaaggcttcccagtaatataattaatactctacttccagagtagaatattaaattttatccgcgtggtgcatcagcacaaatttatcccacaactgttcttctgtctcgacatgc

SEQ ID NO: 431 - DNA, 443 bp, Escherichia coli
aagatgatgtgatgagaaagtcaatttgaataagacaatattaagagctaaaaaaatgtcaaaaaacactaaatcaaaaaataatggcattagaaaatataatgcgaaaacggaggtgaaattagtttatttcaaatgaggaaaatctcccggcgaaaaaaccgggagatgaaagtgtgatgggtatcaaataaacaacagaggagaaatttttaacgcagccattcaggcaaatcgtttaatcccattgcctggcggataagttgcggcttaacgccaggaagcgtgtcggccagtttcaaaccaatatcacgcagcagttttttcgccggattggtaccggaaaacagatcgcggaatccctgcataccagccagcatcaacgccgcactgtgcttgcggctacgctcatagcgacgcagataaatgtactgcccgatgtc

SEQ ID NO: 432 - DNA, 638 bp, Escherichia coli
cagggggtttgttgtgggcaatgatgcatttaagttatcgtctgcagatagaggagatattacaataaacaacgaatcagggcatttgatagtcaataccgcaattctatcaggagatatagtcactctaagaggaggagaaattaggttggtattatagcttgtgcgcgccatgattggcgcgcaatttaaacttagtgctttacatcgctattgtcttgatttctttgaattattttataaattaaaaaaacgactgttatgtataagcaaaggtccgaacgaaaaatacattccaaataaatgcttgcttaaatctctatatccttccccgaaaaatgacacataaaattgagatattccaaaaagagatactacaaataaagatgcctttattttattatttctaataaaaatagaagcaataaaaaataataacaatgatataaatctaatgtttttaaatatattgtcttttatgttagtaatagtcgttagtatgtttgattctccatatattacgtgtagttttttatatacatggaaataattttctttatactgagacatcacaccatcatcaaatggaagtttgaagatggtgcttggtttgctaaccaataaaaagagtgcattcg

SEQ ID NO: 433 - DNA, 299 bp, Escherichia coli
ctttacctggcatgatccacttcgccagaataccggcaataagcccaaaaataatccatgacagaatgcccattgtttcctcacttatctgttttgcattagcgggttagtcgctgataaaaagcatagcacaacatcgggagggcaagatttgtgacgagcatcacggaggtttttttgcgatggcgcagaaattgcgccatcaacgatcagtgataattaccaaccacaaacatcatgttcgttttccgtgtcataagaacgtacggtattcaccagatcttttatcacttcagccg

SEQ ID NO: 434 - DNA, 388 bp, Escherichia coli
gaaaaaggaggcaatatcgggtaaaggcattagcccgacgaatacgtcgggctacaaatattattgtgctgcaggtgttttagcgggttgttgatccacaggttctaactggaagaccacatcgacctgatcatcaaactgaatagcggcctgctcgtaagtttcctgggcggacaccggcgcggcatcggctttcatcatccgcaccattgggctgggctgatagttggaaacatggtagcgcacgctatataccggccccagtttacgatgaaagccgttcgccagttcctgcgcctgatgaatcgcgttatcaatcgctgccttacgcgctttgtctttataggcatccggctgcgccacgcccagcgacacagaacgaattccc

SEQ ID NO: 435 - DNA, 351 bp, Escherichia coli; identical to SEQ ID NO: 31

SEQ ID NO: 436 - DNA, 762 bp, Escherichia coli; identical to SEQ ID NO: 32
  misc_feature (1)...(762): n = A,T,C or G

SEQ ID NO: 437 - DNA, 292 bp, Escherichia coli
cacatttgcgagcacgcatccagtaataacacaggaaactattttatctacgcgttagcgatagactgcttgcatggcgaaaggaggtaagccgacgatttcagcgggacgctgaaacgggaaagcccctcccgaggaaggggccataaataaggaaagggtcatgatgaagctactcatcatcgtggtgctcttagtcataagcttccccgcttactaagactaccagggcgggggaaaccccgctctaccctcactcctgaaagtatgccttcacgataagattgtcaat

SEQ ID NO: 438 - DNA, 631 bp, Escherichia coli
atttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgttattttttattattagccacttgctcgtcttgcttgttattagtcgtatttcacgttgattaatgcggttgcctccagtgcgccagatttaactttgtttgtatcgtagacgtagtaactggctgttatcggaattg

SEQ ID NO: 439 - DNA, 566 bp, Escherichia coli
tatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaaaaaaagccccctcatcatgagggggaaatgcagacaccttgttattttttattattagccacttgctcgtcttgcttgttattagtcgtatttcacgttgattaatgcggttgcctccagtgcgccagatttaactttgtttgtatcgtagacgtagtaactggctgtatcgaa

SEQ ID NO: 440 - DNA, 339 bp, Escherichia coli
cgtattcacatccttttgattggtgataacatgcgaatcggtattatttttccggttgtaatcttcattacagcggtcgtatttttagcatggttttttattggcggctatgctgccccgggagcataaagatgaaaaaaacaacgattattatgatgggtgtggcgattattgtcgtactcggcactgagctgggatggtggtaacgtcacctctaaaaaatagcaaaggctgcctgtgtgcagcctttgtgcaatttaagcgttaacttttaatcttcctgtagataaatagcacgacaatcgcaccaataacggcaaccacgaagctgccaaaatt

SEQ ID NO: 441 - DNA, 376 bp, Escherichia coli
catgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtaca

SEQ ID NO: 442 - DNA, 446 bp, Escherichia coli; identical to SEQ ID NO: 38

SEQ ID NO: 443 - DNA, 388 bp, Escherichia coli
  misc_feature (1)...(388): n = A,T,C or G
tcaccccggtgccgattttcaggcatcctgatttaacttagcacccgcaacttaactacaggaaaacaaagagataaatgtctaatcctgatgcaaatcgagccgattttttaatctttacggacttttacccgcctggtttattaattgcactgtnatccgggcgttcgcccgctttaatcacaataggctgtgtagcctgggcctgtttctctttcacccgcgccagagcggcagcaatcgcatctttatctttggctgcaggttgaacggctgcgctcttatgtcgttcaaggcgagccgctttttcgcgctccagacgagcctggcgcgcttcgaaacgcgctttggcttctgcggcncgcttttcttcctgacgaatagccgc

SEQ ID NO: 444 - DNA, 209 bp, Escherichia coli
aattttaataacgctatctgcggataaagcagaataggtggttaaccccagacataaaccgaggaaaataatgttattgtatttcataatctattgttccttagcgacagattgctgtctgctggttcagtaaggtaccaggagaaacttcaggaagcttgtactcgacaatacagtttgagtttttatctttgccccatgaaacctgt

SEQ ID NO: 445 - DNA, 341 bp, Escherichia coli
catcctcaataccgttaaatgcaacccgaacccccgttgtccctttgctgcattcacttaacgtaatctgaaaagggacggctggacttgtgctaccggtcgttggaaattgtctggcactgtttttttggagatctacggtaaaattaagcgaatccgatgagactgtgcagccataatcgaggacgcgcccgctaattttaataacgctatctgcggataaagcagaataggtggttaaccccagacataaaccgaggaaaataatgttattgtatttcataatctattgttccttagcgacagattgctgtctgctggttcagtaaggtaccaggaga

SEQ ID NO: 446 - DNA, 697 bp, Escherichia coli
agatttactgccaatttccggcagatcggaaagggttaamccatattgatccataagggtacgaatcmcgggctataccgccaggcatggcttgagccatggcattaaattccgcaaattcgggcgctgattcttcccacgcggttattttggcacacaccagatccagcaaggggttttcaggatcgttgagcagcagatgatctaccagttccagcgcctgggtgtattgttcctcgttctgaatacccgccagaaaaggtgccacagcagttagcttttctcctgcttgcaagatgtcggcaatcgcaatcattttttccccttagtacgatgaacagcggtaaagaaatcgtattctttatgcgtcataacttcacgtatgtagcacttttgcgattcaaaaaagaccattgctacaacacgtaattcattgcccccaacattgaaaacataatgcttatccagatatttgaagttatccagagatgggaatactgcttttaatgactcaggttttttgaaatatcccttagcaatcgtgktccccagagccaccaactccgttttatgttgcgggtatttttccgcagcatctttcaatgctttttgagttatcaggtgcattcttcatcacgtccgtkgmcaaattggcaatatgataacatccgttgccagattggcacggatgaattat

SEQ ID NO: 447 - DNA, 215 bp, Escherichia coli
aattaataacttttcgttaggcagttttgggtgtgagttgcaagaggggagactactgaataactcaagttttataatcgaggggaaaatggtgatggcgttcatagcaaaacgccctcaaccataaaggtcgagggcgcttaagatgttaaaaacccgctatccgttaaaaaacaatgttcaactaaggtcagtgacattgcgctaaaaaagcg

SEQ ID NO: 448 - DNA, 395 bp, Escherichia coli
gcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgacgctatgtgtttatgagggagaggtattttcagttgatctggattgttaaattcatataatgcgcctttgctcatgaatggatgccagtatgtagtgggaaattataaatattgaaatagtccaactacttctttattaccaa

SEQ ID NO: 449 - DNA, 641 bp, Escherichia coli
  misc_feature (1)...(641): n = A,T,C or G
ataatcaggtaagaaaaggtgcgcggagattaccgtgtgttgcgatatattttttagtttcgcgtggcaatacatcagtggcaataaaacgacatatccagaaaaatatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgccgcaggcgnagnntgcncgncgncccacctnaccccatgccgaacttcagaantgaaaacnccntaacnccgatngtcggcgggngcctccccatgcnanagtangggaantgccangcgncnnattaaacgaaaggctnattncaaagactgggccttncntttatctgatgtttgtcggagaacgctctcctgagnangacaaatnccgccgggagcggatttgaacnt

SEQ ID NO: 450 - DNA, 314 bp, Escherichia coli
  misc_feature (1)...(314): n = A,T,C or G
gaactacgagtaagaatagctncgaattcccgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcagggggntntnntcttt

SEQ ID NO: 451 - DNA, 236 bp, Escherichia coli; identical to SEQ ID NO: 47

SEQ ID NO: 452 - DNA, 418 bp, Escherichia coli
cggagattaccgtgtgttgcgatatattttttagtttcgcgtggcaatacatcagtggcaataaaacgacatatccagaaaaatatacactaagtgaatgatatcttccgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaattaattaatgtcatcaggtccgaaaataacgagaatatttcagtctctcatcctgttgcgctcctgtcatgtgcattgcttcatataatcactggcgcaaggagcgcgcagggggcggccaatcgccgccgccccctg

SEQ ID NO: 453 - DNA, 551 bp, Escherichia coli
aacaatttgcccatgcgctcggtcatgcgctgcatcgcccggccattttgsgcgtccccgcgaccgccattcgactgttaatgggcgaatcttcagtactggtattaggtggacaacgcgcgctgcctaaacggctggaagaagcgggttttgcgtttcgctggtacgatttagaagaggcgctggcggatgtcgttcgctgatgtggtttacagcaaacatccgccagttaactcccggtgttacaggattagtggctttgcgcgataagatcgtctggtgaaagtcgggtcaccatcataactaactctctgtctaaacctctatccagcatctcctgagcaatacgcagggcttcttcgtgtttgccctgcattgcgccttcttcacgtaatctgtcagcaatggtcatcaagtttctccttttcttgtggtgcgcgttccgctatctcaccaataaatgcacgaaaacgctgggcatcccctgtttgtaatacgtaattaaacagggcttttagctgtctgtcattagtgktccctgtaactagcag

SEQ ID NO: 454 - DNA, 93 bp, Escherichia coli
tggcatctcggtgttgccgatcttcatgatatccagcccgccggaaacttcttcccaaacggttttgctgttatccattgagtcacggaactg

SEQ ID NO: 455 - DNA, 232 bp, Escherichia coli
cgtgccgagatgatcctgtaaccatcatcagttgtgaagtagtgattcacgacttcaaggcgcttttcaaaagggtattttggctttgacatattaggggctattccatttcatcgtccaacaaaatgggtgcagtacatactcgttggaaatcaacacaggaggctgggaatgccgcagaaatatagattactttctttaatagtgatttgtttcacgcttttatttttca

SEQ ID NO: 456 - DNA, 713 bp, Escherichia coli
  misc_feature (1)...(713): n = A,T,C or G
ttagnggatnnaangcccacancctcganggatctaggaggtagaatagcttcgaattccccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccatgtcggtgaacgctctcctgagtaggacaaatccgccggagccggatttaacgttgcgaacaaccgncccggaggggtggnggcaggaccccgccataactggcagcattaaattaagcagaaggccatc

SEQ ID NO: 457 - DNA, 292 bp, Escherichia coli
tgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggttg

SEQ ID NO: 458 - DNA, 282 bp, Escherichia coli; identical to SEQ ID NO: 54

SEQ ID NO: 459 - DNA, 300 bp, Escherichia coli; identical to SEQ ID NO: 56

SEQ ID NO: 460 - DNA, 293 bp, Escherichia coli
cggggtccggcgctcatcaacaatcggggggcagcaaggggctgaaacgggaaagcccctcccgaagaaggggccttgtataaggaaagggttatgatgaagctcgtcatcatactggttgtgttgttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttg

SEQ ID NO: 461 - DNA, 359 bp, Escherichia coli; identical to SEQ ID NO: 57

SEQ ID NO: 462 - DNA, 673 bp, Escherichia coli
gcaacccatgtcctgacctgggttcgggggacaccaaaacgtgccgagatgatcctgtaaccatcatcagttgtgaagtagtgattcacgacttcaaggcgcttttcaaaagggtattttggctttgacatattaggggctattccatttcatcgtccaacaaaatgggtgcagtacatactcgttggaaatcaacacaggaggctgggaatgccgcagaaatatagattactttctttaatagtgatttgtttcacgcttttatttttcacctggatgataagagattcactgtgtgaattgcatattaaacaggagagttatgagctggcggcgtttttagcctgcaaattgaaagagtaagagtcttcggcgggaaattattcccgccttacttacggcgttgcgcattctcattgcacccaaatttattcttcacaaaaataataatagattttattacgcgatcgattatttatttcctgaaaacaaataaaaaaatccccgccaaatggcagggatcttagattctgtgcttttaagcagagaatacaggctggttacgttaccagctgccgggcctttagcgccgctttcgatggtgaaggacactttctgaccttcgtccagagatttgtaaccatcgttctggatagcagagaagtgtacgaac

SEQ ID NO: 463 - DNA, 630 bp, Escherichia coli
tggtggcattggttgctggagagagaaaacccccgcacgttgcaggtatgcacctgacaacaccacgggggctaatcttgactctagaccactcaagaatagccgcgaaacgttgtcattacaacacaggcggctatatgacgttcgcagagctgggcatggccttctggcatgatttagcggctccggtcattgctggcattcttgccagtatgatcgtgaactggctgaacaagcggaagtaacgtgtcatgcgggcgtcaggctgccgtaatggcaatttgcgcccggaccaggccgcaggggggaaactctgcggcctttttcgttcttactgcgggtaaggcacccagtcgccgccgttcaggcgaacgtacggtttatcctggtattgaataactactgcatttgagttctcggagaccggtgctgtttgtggcaacccactggtgagttttttccagtcaacattgtcttcggtgaaaatcttgccatcgagaacgcgaaccaccagatcggagatagccaggaagctgctcggttgttcgatgacaatcggtgccccctgatgcggtgccttcatgccgaagaatttcaccccaacggggacgtcggtgatagacgggctag

SEQ ID NO: 464 - DNA, 391 bp, Escherichia coli
ctcaggctgctgattgtttttttgtgcaatggcgcggtattagcgtcgttgctgtcgatggagagaatcataaacgtggtgaatgatgattgttagcaaggaaaactgtcaaaaatcttcaaaaaatttgagggataaggccggaatggctccggccagagggaagttaaccgcgaagctgttgctgcttgagggtcgttttaaccagacgccaggcgctccatacgccaaaaccgcgtctggcccagcggaccagcatattaggatggcgaatcgtccagatcgccatcacgctactgccaaccagcgcccaggagcgcagacttagcagcatattccagcgacgatcgtaagcgcctgttgtctccagccattcacgacgactggcgga

SEQ ID NO: 465 - DNA, 625 bp, Escherichia coli
aacacaccacaccataaacggaggcaaataatgctgggtaatatgaatgttttaatggccgtactgggaataattttattttctggttttctggccgcgtatttcagccacaaatgggatgactaatgaacggagataatccctcacctaaccggccccttgttacagttgtgtacaaggggcctgatttttatgacggcgaaaaaaaaccgccagtaaaccggcggtgaatgcttgcatggatagatttgtgttttgcttttacgctaacaggcattttcctgcactgataacgaatcgttgacacagtagcatcagttttctcaatgaatgttaaacggagcttaaactcggttaatcacattttgttcgtcaataaacatgcagcgatttcttccggtttgcttaccctcatacattgcccggtccgctcttccaatgaccacatccagaggctcttcaggaaatgcgcgactcacacctgctgtcacggtaatgttgatatgcccttcagaatgtgtgatggcatggttatcgactaactggcaaattctgacacctgcacgacatgcttcttcatcattagccgctttgacaataatgataaattcttcgcccccgtagc

SEQ ID NO: 466 - DNA, 623 bp, Escherichia coli
tgcttttgaatatgtgctcgcaatcttgagaaggaaatggcgaccacgaaagaaaaggcaaaaacgataatctgaaagagccaaggtatttcagtataagcattgaatgcgacagtaaactctttcggtatcagccagagagtgagaccaaaaatgataatcgtatacataagtctttcgagtggctcgttagcaaaaagtttcaacaatggagtaaatacatccaacatatcaataactctcaactgtaagggtattgaaatgttaacacaagctctcgctgtaggggtatagccgagaccaccgaagcccggaggtggtgaaataaaaccgggcacaacacgaaggcgcatttccgatatccataaagagtcggtcttgtctgttaaatttaaatggtgggagtgcgcctccggttgtaaataacgacattgctgtgtgtagtcctggcggcatcagtttttttcttgaagttcggctgatgtccgccctttttaaagtgaattttgtgatgcggtgaatgcggctaagcgcacgtggcacagttaaaagtcatgttagtccttattggtttgggtgggaaagccgactgtaattgttaactggttgcagtcacctggagg

SEQ ID NO: 467 - DNA, 234 bp, Escherichia coli
tgtttacttacaagagattcatctttgtataaataaagataagtaattacgcataaaacaacaatgattataatagcaaaaataaatattatcatctttgatagattacttgagatagccagcatcttgtaaagcctttatcgtttttttatgctctggattaatataatcactacatctatctgagcaatctgttgttgatggacatgtcaacccatggtcatttacagccaa

SEQ ID NO: 468 - DNA, 529 bp, Escherichia coli
attagctatttcggctaaaatagagactacatgtcttcggtccatctcacttaaggagtgtagttccgttgtaagtttttccatagcttgcactgctaaatttcgaacaaggaattttctgctggtaatctctaaaaagatggcatggtttacaatgatttttgtttccttttgattattatgaacaactgtccatgatttcgtttaagaatgaagagaaatcactaaacgaactgaatatattttctgtgccaatattatctctaatttcaaaaaagttacttttaatgtcggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttttccttatcagttcgttgatgtcagtggttttgaccacgagggagcttcacgcgagttattgaaaaccctga

SEQ ID NO: 469 - DNA, 261 bp, Escherichia coli
caaagaaccttcaacatgaaaaatatccatttgtttgcaaaaaaagattattaggaaggaaattaatgcaattatcgaaaattcaaaaaatatccaaaaatagtatactttattccagaagagttcaatataatgtttgtcttcaatttttcttacttcagggtaatatagattgctcattacattgtgagcttcatctttatttaattttctgttgactccagctctccgtgataacggttttataattagatgcttatc

SEQ ID NO: 470 - DNA, 98 bp, Escherichia coli; identical to SEQ ID NO: 66

SEQ ID NO: 471 - DNA, 259 bp, Escherichia coli
agcgcgaacgaagtcgatgtgctgcagcttcggtttgtacgggtgacgctgtacgtcctgagctttaactttgatttctttaccgtcaacaacgatggtcagaacttcgctgtagaattcagctttagcttgcatgttcatgactttgtcgtgatccagctcgatagccagcggcgcttctttgccaccgtagatgattgccgggaacttgttagcggcacgcaggcggcggctcgcacccttaccctgctctttacgt

SEQ ID NO: 472 - DNA, 94 bp, Escherichia coli
aaaaacggcgtaaagaaaggatgcaaacatgttaataaaaactcaaattgatcccacgtatatattacgccgcaaaatccttacaataaacagg

SEQ ID NO: 473 - DNA, 174 bp, Escherichia coli; identical to SEQ ID NO: 69

SEQ ID NO: 474 - DNA, 138 bp, Escherichia coli
ctgtaaaaacgtcaaaaagagtgttttatcaacagaagaatggaggtctgacagatagtagtaatgcaaaaaaatggagacttaagttgaatgaacgggagtaaagcgaaaagactatagagtgaaggagaaattccc

SEQ ID NO: 475 - DNA, 191 bp, Escherichia coli
tttgttggcttaatattctattgttatctttatttatagatgtttatattgcatgaggtggtttttggagagaagaatgaggaagatgcgtcgagccacagaaacgttagctttacatatagcggaggtgatgtgaaattaatttacaatagaaataatttacatatcaaacagttagatgctttttgtcg

SEQ ID NO: 476 - DNA, 245 bp, Escherichia coli
cggccatttatacaggaaaagcctatgtcagaacgtaaaaactcaaaatcacgccgtaattatctcgttaaatgttcctgcccaaactgcacccaagagtcagaacacagtttttcaagagtacaaaaaggtgcccttttgatctgccctcattgcaacaaagtattccagacaaatcttaaagctgtagcctgattgattttattagtaacaagtattttttatattttaataatatatttaaa

SEQ ID NO: 477 - DNA, 319 bp, Escherichia coli
aaattttcaggtaccttgtcaccatacttttttttctgagcattaatgatattttgagcttcttgaggatctttaactccccacatttggtggaaagtattcatattaaaaggaaggttgaataatttgtctttataaatcgccagtggagaattagtaaaacgattaaattctactaaatcattaacgtaatcccatatatatttatcattggtatgaaaaatatgtgcaccatatttatgaatctggataccctcacagtcctctgtgtacgcatttccaccgatatgatttcttttctcaatcactaaaacttttt

SEQ ID NO: 478 - DNA, 149 bp, Escherichia coli
gcagtgatcgaagcgatgacgaagtgtatggaaaaatcagaaaaactcagcaaatcctgatgactttcgccggacgtcaggccgccacttcggtgcggttacgtccggctttctttgctttgtaaagcgccaaatctgccgatttcaac

SEQ ID NO: 479 - DNA, 330 bp, Escherichia coli; identical to SEQ ID NO: 75

SEQ ID NO: 480 - DNA, 191 bp, Escherichia coli
tttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttc

SEQ ID NO: 481 - DNA, 188 bp, Escherichia coli
tccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttca

SEQ ID NO: 482 - DNA, 172 bp, Escherichia coli
caaaggcgaacaaagcctgtgaagcccgaaggctccacagacagtgctacttgaaggccttactgtttcttcttaggagcgagcaccatgatcatctggcggccttcgatcttcgttgggaaggattcgaccactgccagttcttgcaaatcgtctttcacgcgattaagca

SEQ ID NO: 483 - DNA, 266 bp, Escherichia coli
tggagaaaacgggtgattgataaagcaatcatcgttctaggggcgttaattgcgctgctggaactgatccgctttctgcttcagcttctgaactgatagcggaaacgtaattaagggctaagagcacactactcttagccctttaacatttaacgcattgtcacgaactcttctgccgccgttgggtgaatggcgacggtattgtcgaagtcttttttggttgcccccatcttcagcgccaccgcgaagccctgcaacatttcgtc

SEQ ID NO: 484 - DNA, 259 bp, Escherichia coli; identical to SEQ ID NO: 80

SEQ ID NO: 485 - DNA, 73 bp, Escherichia coli; identical to SEQ ID NO: 81

What is claimed is:

1. A method of screening a candidate compound for the ability to reduce the activity or level of a gene product required for cell proliferation, said method comprising the steps of:

expressing an antisense nucleic acid against a nucleic acid encoding said gene product in a cell to reduce the activity or amount of said gene product in said cell, thereby producing a sensitized cell;

contacting said sensitized cell with a candidate compound, wherein said candidate compound is not previously known to possess the ability to reduce cell proliferation; and determining whether said candidate compound inhibits the growth of said sensitized cell to a greater content than said candidate compound inhibits the growth of a nonsensitized cell.

2. The method of claim 1, wherein said cell is selected from the group consisting of bacterial cells, fungal cells, plant cells, and animal cells.

3. The method of claim 2, wherein said cell is an *E. coli* cell.

4. The method of claim 2, wherein said cell is from an organism selected from the group consisting of *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni,* and *Chlamydia trachomatus, Chlamydia pneumoniae* or any species falling within the genera of any of the above species.

5. The method of claim 1, wherein said antisense nucleic acid is transcribed from an inducible promoter.

6. The method of claim 5, further comprising the step of contacting said cell with a concentration of inducer which induces said antisense nucleic acid to a sublethal level.

7. The method of claim 6, wherein said sub-lethal concentration of said inducer is such that growth inhibition is 8% or more.

8. The method of claim 6, wherein said inducer is isopropyl-1-thio-β-D-galactoside.

9. The method of claim 1, wherein growth inhibition is measured by monitoring optical density of a culture growth solution.

10. The method of claim 1, wherein said gene product is a polypeptide.

11. The method of claim 1, wherein said gene product is an RNA.

12. The method of claim 10, wherein said gene product comprises a polypeptide having a sequence selected from the group consisting of SEQ ID NOs.: 243–357, 359–398.

13. The method of claim 1, wherein said candidate compound is a natural product.

14. A method of screening a candidate compound for the ability to inhibit proliferation of a microorganism said method comprising:

(a) identifying a gene or gene product required for proliferation in a first microorganism;

(b) identifying a homolog of said gene or gene product in a second microorganism;

(c) identifying an inhibitory nucleic acid sequence which inhibits the activity of said homolog in said second microorganism;

(d) contacting said second microorganism with a proliferation-inhibiting amount of said inhibitory nucleic acid, thus sensitizing said second microorganism, (e) contacting the sensitized microorganism of step (d) with a candidate compound; and (f) determining whether said candidate compound inhibits proliferation of said sensitized microorganism to a greater extent than said candidate compound inhibits proliferation of a nonsensitized microorganism.

15. The method of claim 14, wherein said step of identifying a gene involved in proliferation in a first microorganism comprises:

introducing a nucleic acid comprising a random genomic fragment from said first microorganism operably linked to a promoter wherein said random genomic fragment is in the antisense orientation; and comparing the proliferation of said first microorganism transcribing a first level of said random genomic fragment to the proliferation of said first microorganism transcribing a lower level of said random genomic fragment, wherein a difference in proliferation indicates that said random genomic fragment comprises a gene involved in proliferation.

16. The method of claim 15, wherein said step of identifying a homolog of said gene is a second microorganism comprises identifying a homologous nucleic acid or a nucleic acid encoding a homologous polypeptide in a database using an algorithm selected from the group consisting of BLASTN version 2.0 with the default parameters and FASTA version 3.0t78 algorithm with the default parameters.

17. The method of claim 15, wherein said step of identifying a homolog of said gene in a second microorganism comprises identifying a homologous nucleic acid or a nucleic acid encoding a homologous polypeptide by identifying nucleic acids which hybridize to said first gene.

18. The method of claim 15, wherein the step of identifying a homolog of said gene in a second microorganism comprises expressing a nucleic acid which inhibits the proliferation of said first microorganism in said second microorganism.

19. The method of claim 15, wherein said inhibitory nucleic acid is an antisense nucleic acid.

20. The method of claim 15, wherein said inhibitory nucleic acid comprises an antisense nucleic acid to a portion of said homolog.

21. The method of claim 15, wherein said inhibitory nucleic acid comprises an antisense nucleic acid to a portion of the operon encoding said homolog.

22. The method of claim 15, wherein the step or contacting the second microorganism with a proliferation-inhibiting amount of said nucleic acid sequence comprises directly contacting said second microorganism with said nucleic acid.

23. The method of claim 15, wherein the step of contacting the second microorganism with a proliferation-inhibiting amount of said nucleic acid sequence comprises expressing all antisense nucleic acid to said homolog in said second microorganism.

24. The method of claim 14, wherein said candidate compound is a compound not previously known to possess the ability to inhibit cellular proliferation.

25. The method of claim 14, wherein said candidate compound is a natural product.

26. A method of screening a candidate compound for the ability to inhibit proliferation said method comprising:
(a) identifying an inhibitory nucleic acid sequence which inhibits the activity of a gene or gene product required for proliferation in a first microorganism;
(b) contacting a second microorganism with a proliferation-inhibiting amount of said inhibitory nucleic acid, thus sensitizing said second microorganism;
(c) contacting the proliferation-inhibited microorganism of step (b) with a candidate compound; and
(d) determining whether said candidate compound inhibits proliferation of said sensitized second microorganism to a greater extent than said candidate compound inhibits proliferation of a nonsensitized second microorganism.

27. The method of claim 26, wherein said inhibitory nucleic acid is an antisense nucleic acid which inhibits the proliferation of said first microorganism.

28. The method of claim 26, wherein said inhibitory nucleic acid comprises a portion of an antisense nucleic acid which inhibits the proliferation of said first microorganism.

29. The method of claim 26, wherein said inhibitory nucleic acid comprises an antisense molecule against the entire coding region of the gene involved in proliferation of the first microorganism.

30. The method of claim 26, wherein said inhibitory nucleic acid comprises an antisense nucleic acid to a portion of the operon encoding the gene involved in proliferation of the first microorganism.

31. The method of claim 26, wherein said candidate compound is a compound not previously known to possess the ability to inhibit cellular proliferation.

32. The method of claim 26, wherein said candidate compound is a natural product.

33. A method of screening a candidate compound for activity against a biological pathway required for proliferation, said method comprising:
sensitizing a cell by expressing an antisense nucleic acid against a nucleic acid encoding a gene product required for proliferation in a cell to reduce the activity or amount of said gene product;
contacting the sensitized cell with a candidate compound, wherein said candidate compound is not previously known to possess the ability to reduce proliferation; and
determining whether said candidate compound inhibits the growth of said sensitized cell to a greater extent than said candidate compound inhibits the growth of an nonsensitized cell.

34. The method of claim 33, wherein said cell is selected from the group consisting of bacterial cells, fungal cells, plant cells, and animal cells.

35. The method of claim 34, wherein said cell is an *E. coli* cell.

36. The method of claim 33, wherein said cell is from an organism selected from the group consisting of *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni,* and *Chlamydia trachomatus, Chlamydia pneumoniae* or any species falling within the genera of any of the above species.

37. The method of claim 33, wherein said antisense nucleic acid is transcribed from an inducible promoter.

38. The method of claim 37, further comprising contacting the cell with an agent which induces expression of said antisense nucleic acid from said inducible promoter, wherein said antisense nucleic acid is expressed at a sublethal level.

39. The method of claim 38, wherein said sublethal level of said antisense nucleic acid inhibits proliferation by 8% or more.

40. The method of claim 38, wherein said agent is isopropyl-1-thio-β-D-galactoside (IPTG).

41. The method of claim 39, wherein inhibition of proliferation is measured by monitoring the optical density of a liquid culture.

42. The method of claim 33, wherein said gene product comprises a polypeptide having a sequence selected from the group consisting of SEQ ID NOs: 243–357, 359–398.

43. The method of claim 33, wherein said candidate compound is a natural product.

44. A method of screening a candidate compound for the ability to inhibit cellular proliferation, said method comprising:
contacting a cell with an agent which reduces the activity or level of a gene product required for proliferation of said cell;
contacting said cell with a candidate compound, wherein said candidate compound is not previously known to possess the ability to reduce cell proliferation; and
determining whether said candidate compound reduces proliferation to a greater extent than said candidate compound reduces proliferation of a cell which has not been contacted with said agent.

45. The method of claim 44, wherein said agent which reduces the activity or level of a gene product required for proliferation of said cell comprises an antisense nucleic acid to a gene or operon required for proliferation.

46. The method of claim 44, wherein said agent which reduces the activity or level of a gene product required for proliferation of said cell comprises an antibiotic.

47. The method of claim 44, wherein said cell contains a temperature sensitive mutation which reduces the activity or level of said gene product required for proliferation of said cell.

48. The method of claim 47, wherein said agent is an antisense nucleic acid directed to a gene or operon required for proliferation.

49. The method of claim 44, wherein said candidate compound is a natural product.

* * * * *

UNITED STATES PATENT AND TRADEMARK OFFICE
CERTIFICATE OF CORRECTION

PATENT NO.    : 6,720,139 B1
DATED         : April 13, 2004
INVENTOR(S)   : Zyskind et al.

It is certified that error appears in the above-identified patent and that said Letters Patent is hereby corrected as shown below:

<u>Title page,</u>
Item [75], Inventors, delete all inventors and replace with:
-- Judith Zyskind, La Jolla, CA (US); R. Allyn Forsyth, San Diego, CA (US) --

Signed and Sealed this

Sixteenth Day of November, 2004

JON W. DUDAS
*Director of the United States Patent and Trademark Office*

UNITED STATES PATENT AND TRADEMARK OFFICE
CERTIFICATE OF CORRECTION

PATENT NO.     : 6,720,139 B1
DATED          : April 13, 2004
INVENTOR(S)    : Judith Zyskind and R. Allyn Forsyth It is certified that error appears in the above-identified patent and that said Letters Patent is hereby corrected as shown below:

Column 77,
Line 15, please delete "content" and insert therefor, -- extent --.

Column 78,
Line 29, please delete "is" and insert therefor, -- in --.
Line 54, please delete "or" and insert therefor, -- of --.
Line 62, please delete "all" and insert therefor, -- an --.

Signed and Sealed this

Eighteenth Day of January, 2005

JON W. DUDAS
*Director of the United States Patent and Trademark Office*